United States Patent 11,098,325 (ADENO-ASSOCIATED VIRAL VECTORS FOR GENE THERAPY) - sequence listing, part 2

SEQ ID NO: 114 - DNA, 344434 bp, Homo sapiens
tgggccgcagccctccccgccccgccgaccgcggtcacacactctcggagcctccccgtgagcgggagcgcggcgcacggcgatgcgccgaggcgggcgctgaggcggcgccgcgcgagcagcagcagaggcggcggcggcccccagcccagcccggcgccgccgccgagcccgggccccaaggtgcggcggcgccccaagttcccgccatgagcagccggctcggggggctccgcggccccggggactcccgccccgccgggcgcgaccgcagcgccccgcggccccgacgcgcttaacgttgtcgcttgccggtcccgccaccgccgcctccgccgccgctcgcgtcctcgccgccaccgcctcggccgctgcagctccgccggcagcatgtctcgaaggaagatttcgtccgagtccttcagctccctgggctccgactacctggagaccagcccggaggaggagggggagtgccccctgtctaggctctgctggaatggcagccggagcccgcccgggccgctggagcccagcccggccgcagctgccgctgccgccgccccggccccgaccccggctgcttctgccgccgccgccgctgccactgccggggccaggagggtgcagcgccggaggcgggtcaacctggactcgctgggcgagagcatcagccgcctgacggcgccctcggtgagcggggggcggaaggggggaccgccttcgggggagagaacgcggatctgtaaagttggcgctgggcgagccggggcgcgagcgcagagcccgaccgctggggggcggcccggccttaccctgcacggcctagggttccagtggctccggcgacagaggatcccctaggctagggcggaagaggggactacagcactgggaaggaataagattccactcctttggggtatcctgattcgggggcctgtctgcccacctctagccttgaaccctacttcaccactgttccccctggacagccccagtgctgcttcacacccacctgttttctttcccctaaactttcccaggcactgtgttctgcagttcagcttccctgtctttcatcctgttctccagcatcccaaaggagccccaaccccttccaggaaacccttcctctccttatttcccacactctcttggtcttagcgtgaccttctctgacatctttgaattccacaggctatctgcattctatgttgcatcctttttctcacatcttcagatactttttgccagatacttttctgagttgccttctgttcaagtaatctctaatctcgagttgtcctcaccccgtagctttttttctttttctttcttatccactaggcatttattcttctctgggtaaacctggtgtctggatttctttttttttaaattaaatttaatttaaagtcccgggttacatgtgcaggatgtgcagatttgttacataggtaccaaacgtgtgccatggtggtttgctgcacctactaactcatcacctaggtattaagcttcgcatgcattagctatttaaaccgctctgtacttcttgcacctgtacctcatcctttactctctcctcaatggattctctagtgctttctctctcacattagctatttaaacctctctgtacttcttgcacctgtacctcatcctttactctctcctcaatggattctctagtgctttctctctcacattagctatttaaaccgctctgtacttcttgcacctgcacctcatcctttactctctcttcaattgattctctagtgctttctctctcattttttggtggcttctttatattaggcccttcctaaatatttgtggaatgaataaatgcctctccaaacttgtggtcatcttgggatgtctgtatcagcagtttcaggtgtacaacaaactccccctggttgtaggcatccttccagaggagtactgccttattcctgcccaggcatttcagctacccttggcttttacctcttgcaggaatgccagacctctgatccaatcttaccgtgtctgggagagctctgttttaaagaaatccactctgttgcagacagaatttgaaaaagattcagcgtcaaacctccacccatcttttatgctcaccctgaccttggatacaagagctttagctcctcctgacagcactttcacctgcccacccctaggacttttacttttttaaagtttccgaaatgaatctgaacactgatcttgtttgattactgttgagtctctcttttgagattactactgcaaatgatggtaggggggacctaagaaggagtggaaccctgaggggactgagtacgggtaccagacaggtctacaaatattcttgtggcacttgtattaatggagaatgatttttttcttttacgagacctgattgaagatgtataaatcacttattacattatttattttgaactaatttaattcttaggaacacatattgagaaacagtcatcttcctattcttgtgtattttcgtatttgatatatctttctgccactttttctttcatcattaacctagaaaacaatcctcagaatagattggctactctttgctgttcttccctgccaatatttcccaggcagcgtaattttataaactatttgatgttgcaaattgttgaaaatatttatttacaacaggagtccaatgaccccgagcgtctgtaggcttgtgtcagtacttaaagcaacatttgtgcaataaaatagttatttagtacaacagattcttatttaatgaaatgattttgctaaagataatgattagtttggggagaattgttgatataaccttggaggtttttttttttttttttttttttttttttttttttttgcctaagagaatttacagatttctaaaaagtaatgtcaatgcctctgataatgctaatttaagctaagactattttcaacaacttacatgaggagtagataaaagaaactgagaaatgcagtattttctgctagaataagaggaaggaaatagtctctgatggttacttttataagttaaatttgaatgactggctttttgctggatgaaaagaatgtatccagagaatggttttcagaataagcaatttaaaaataattgtgatgatcaaataaatgcaacagctctatatactttccatgccatagttgttttctattatgaaaagggtctgtcaggtggacgctgagaacatacaggtgaatatactgtaaacattttcaacataacacatgtatagaaaaattctccttggttaaccatatcatcaatagacttagtgacacaaataaaagagagagattatatttcaaagcagtgactcatttctgggcagtccttaccttattttatttggcaagttagaacactagctcaaaaagttccagtagattcattttttgacattgtcaggatttgaaacttctttgaatactcttcaggagatggattatgtcctctctattctctcatgaaagctggacatttttttgtttttgaaccactgagagtagccattaccagagcctttttagatgggaatttctagttgttttgaatgttgtgagctttcttgcatgccatcacaatatacttcaggagaaactgtacttgccatggaagctcctgttttgtcagttgtctcatcgtggcatgtctcagtcacttgggatttcttctttattcagaatgatttgcaaatagaaaaatgaaaatttatttattaaactagttatttgacccatgggatatccacactcaggtttttgatgcttaatagtcactttaagatgcaccgatgttgagtataaaggttataataatttctaatactatttaataagagtaagttgtattggtgaaattgaaaaaaaattccagaattcgggagacctgattctaattttgccttgaacaatgagaaacttacatatctctggacacattactttaaatatctgggatttcccaggctttggacaaactgtcatattggcatatgaaagggaaacatgggccaggcgtggtggctcatgcctgtaatcccagcactttgggaggccgaggcaggcagatcactaggtcaagagattgagaccatcctggtcaacatggtgaaaccccgtctctactaaaaatacaaaaattagctgggcatggtggcgtgcacctgtagtcccagctacttgaaaggctgaggcaggagaattgcttgaacccgggaggcagaggttgtagtgagccgagattgcgccactgcattccagcctggcgacagagcgagactccgtctcaaaaaaaaaaaaaaaaaaaaaaaaaaaaggaaaacatggcatatattataagttttaaaacttttgaggaaagtagtttactttttaagataggggcaccaaaatgctatttaatccacccaattatttaaaaaatattgtagtatctatgtggcaggtattgtgcagagcatttggaaagacaaatgctgaacaaaacatatctagtctttgatttcatggaacttctttaatcattatctttattttaatgaaactatataaagggaaaacataagaactccaattgtcttggcgaaatctaggggaagttttatttgtcattcactttgggtagttttgttcattgtgaatctctggggtgcagccataataataaaaataaccctccaattagcaggtcatgatgatgcacgcctgtaatcccagctacttgggaggctgaggctcgagaatcgcttgaacccgggaggcggaagttgtgatgagctgagatcacaccactgcactccagaccctgggtgacagcgagactctgtctccaaaacaaaacaaacaaaaaccctcaagaccttaagacctgattgaagatgtataaatcatttattacattctttattttaaaataatataatagttgggaatacatattaagcaacagctggggatttcacatcaagggtgaacttagcgacttatttatttggattttattcttaaatgagagttgcttagttaccctatcactgcgacatcaattttgggtttgctggtgtcagcctgtcagtgaagatacaccactagagtcatataagggcaaggcttctctaggtttcttgacagagaacattgcaagtggctttgaagacctcagaagctttagagagcagaatgtcaggaaaaaaaagtaacagaattggaggagtggcaaataaggagaggagagctactgacctgtggagttgttcaagaaacagagactagtgaagaggaaaaaatgaaggtggaagcttagattcaagtgacaaaaaagcataaattattattttggggaaggaaattatcttaatacatgtcaaggaaagaatgaaaaggcataaaatactttagcttctgttgatattaaataaaatgagctctctgacatgtataaaccttgaaaaaaaaccttagaaagtatgtgtgtaactaacatgtagacaatgaaaaatgtaaaaaatatattcgtaaggtaggctattggacaaatttaggtagtttaattaaagctttttaaatttggggcttaatttggctaacaaagttatagaaacagattcattaccattataaaattatataaagtatatttcagttgtttaatgttttcacatttgttgaaaatagatactataatctgaaatcagaatttaatggcaatctattgcctttctttaccttatccccaatcatttagaaacaacatgacagagttgaaagcacaaagttttggagtctgacaaatttcggtttgagtaatcctctgctgagccccttactaagtatgagtccctgggaaagctaactcttatcttctctgagccttagtttcctcttttgtgaattaggaataacaactaccttgtaggtttgttgtgtataaggaggaatattcttcttaaagcttcctaaactcaatagatgatagtttcagggtgagatctattaattttaactgaatttgaatgcctcaaagtgatctaaatttttcattttctttttttctcaataattcacttgctagtcacctaattggaaaagtttatagaataggttaacagatgtcaagtacgaaaaaaaaaaaaaaagtaataagaagcactgtattttgtcggcatagcccagacaatccattaaaaaaattaaaactggagtccctttttggcccctgggtatgactcatgtgtgtacacagacatataaaaattgcagatccaaacatttccatcagattactgactgctgtgtggcaatatgaaaactactttataaattctataaaaatacaaggacatatatatttggtagaatgtagatatttcatgacaagttaattttaaattagaaaaattgtaggtgaaagagaagttatttatttcagttgcctaagaattccaagcattcttcatctactgcattcaaactaatctgtatgtgtgttcaaaggccttgatagtgagatgcaacaattacatagctaatgctgtttatattttatggtgctgccttcttgtttggctattggttcaattgctaggctttcttttgtctttttctttttctttttttttttgaaatagggtcttgctcctgcctcagccttctgaagagtagaactttcactttaaagttacattttgtcaatgagaaatgacatcagtgattattaggtttgtaagtagaagtcagacactctgactatatattatagtattatatattatatactcctttttatatatattaaagatatatatttatatattataaatatatatgtgtatatattataaatatatttatatatttaatatattaaaaatatattttatatatattatatagtcctgattatatattcctttttagtgtatagtttatttacctttaaggactctaagatgcataggtgaagtacttgagtgctattatatatttttcccatctatgtcatcattagtctttttgttcacctttttgtcctgttgccgttaattatacagagctctaagtaaaataaaacataaatattttattgaatatgataggaaaataaatgcactgtcatttgacacatacattgttgatcatgagttactaggaaggtataattttcttttttgagatttcacacacatgtaggcacataggccgggagaatatttgcaagggctatctattgagcaggctttcttcacaggccctttgttcgatgcatgaggcagtgggttaatttaacatttaaagcctctgtccttgatattcttatgtttaacttgtgtttagcatagtatggttgttcaataaaatgcttaggagggccaggcgcagtggttgacgcctgtaatcccagcactttgggaggctgaggcagatggattgcctgaggtcaggagttcaagacgagcctggccaacatggtgaaaccctgtctctaccaaaaatacaaaaattagccaggcgtggtggtgggcgcctgtaatcccgctacttgggaggctgaggcaggagaatagcctgaaagtgggagggggaggttgcagtgagccgagatcatgccactgcactccagcctgggtgacagaggaatactccatctcaaaaaaagtaaaaaaaaagtgctcaggagaagtaaatacatgtttttgtttaattgttcaattttattaatgtttcttttgtgtttaatttttttttggtggtatatttagttccatcaaccaaaatatttagatttttcatccagcctgtgatagacatattcaagtatgcgaacctgtttgaattttgcttacacctgctatttaaagcaaaacttcggaaggaagtcgttttacaaaaagagcagatggaacagtatcctcctccttggactctttgagtcgtccatttatataatattttaagaagttaggtaaatgtaatgactcttctacagtctggattgcttatattttctgcccaattctctgtcaaatgagaagaaatgtttgtcaacaagtaggctactgttgccaaaaatgcactactaggagatggaaatgacataattatggcccttaaacatcacttcaggacaggatctgaagatctagaattatgtgctgttagctcagagtacctcataacattgagggctagagtcatttaggaggtagggcagtgggaaatatcttggaaggcgggaaatttgctggggctgttgtagggaaatgagaaagagtaaacattcttataaatagtgagaaatcacttccagagcaggctttatttgaggcttattaaacagttcttcatttaatctagtagctctcaagcttcattgaacacaagacatacctgaggaaaattgttagaatgcagattcctgggtctcatcctcagaggatctggttggatagttccagggaggggcccaaactacattttgaacaaaactccaggtaattgctcagcatgctgaaggtatgtctagaggtgactgaattccagaccttgaggactactgagcagtgagctctatgggctgatttttgggaagaatgatcctgaaagtcgcttcctttgggattaatgtatcccagacaactattacctttactgggttagggataaaggtggtgaattggtgctgttatccccacatcctatggctgtatcttttgtggtcgaaataatcttactggttgtatggtagaaggtatttgaggtttcaccatttgtagctttaattatctgtggactctgcccgtttttcccgaggatgttttgttaactgcttatgtttatgttcagtagttcgcatgtcattactataagtatcttgtgacccctttttccaaaacagagaaacagatatttgaaaaggttggggattgtagaaaaaaagaagggtggttgtgagggtgaatttgacattatcaccagcatttgtgtttttcagagtgagattgacacaacatttctcaaatgctccatctactggttcattttggaggagtgatttgtttacatgccaatgaaaaattaaaaaggtaaagggagaaaaaacagatctgaatgccagaattttttttttctagaaagaaaacaataggaggttcagatatcagatatatagggccacctctcaaaccttaccaaaatatgacactaacattaatgcttcctaatctctgcatccttagccgttcattcagtggtgaagttgggtgggggtctctcatttagttctccaagtaaataaatggtgatccaacatttgaagaatttgtatttgcagacaactctaataatctatcatgaaaggaagttatctgtgtggaggtcctgatgttaccttaattgtaagtccataaagtccacttgactcattttcctttcactgtataatatttgttatgcgtgagtctactgtggccaatggcaaaaatcagaatgttctaaaacatccttccattccttgttgctttatgtctatgcttcttcatacatgaaccctccaacttaatactgggagaggatggtttttctgactgtttttatgtacacacgcacacgtgtatatatatcgtgatttctgtcactccattttttcccctatggaatcctaacttatcactcacatctccattatgggacttattgtattgtaccttgattttggtttattctgcctctttgagatggaaatcctgtcttatttatctatgtatgcgcatgcctagcagagtatctgaattataaaggcactcaataaatgtttgttaaaagaatgaataaatgattgaataagtccttgtgtagtttatgatgtatttggtactgctcttttggctataatgattttgtgatttttaattgattattttatctgactgttctgtttgcagctttttctcagacataaacgggaatatagttataacattattttttagaatgcgttaagattttctaaacattctcctacctgacattttattgggacttcataataatctgtaggttttatgcaaattgcctctcactttgggtagtatgattatctttttttttttttttttttttgagatggagtcttgctctgtcgcccaagctggagtacagtggcacaatcttggctcaccacagcctctgcccaccgggttccagcgattctcctgcctcagcctcctgggtagttggaattacaggcgcatgccaccatgcctggctaatttttgtatgtttattaggggtttcgccatattggctgggcctggtgtcgaactcctgaccccaggtgatctgcctgccttggcctcccaaagtactgggattacaggcgtgagccaccgcaccaggccggatagtatgattatcttaaaatgcctgtagacacaacagttatttggggttgctgatgtgctgccacttacaagggtgtctatattatctcctaaagaaatgtgtatctgtaagctagagggacagtaaatctatcatgctgtgttgttcattattattttagtatgtaagaaatcctgtattaccaaacattctattaaatacaattctacaaaccagcatatccatatatctatcttacaataatcattagtggacacaatagtggcacagggagggatagtgtccttgaaaaaagtgtagagttagaaattgcttgtttaaagattggggaagagaactgcctaggaataggaagaagtgttattgggtgttttttgagggcccacttgaggttggagataatgagtatgtagatcaaattgggaagatgagtatgacatgcagaggtataaagcaatgatagtattgtttatgcattagaaggcctatatgtcagattgagcttgaggtgtttggggacaatccgctggagtggagggttatgtcttcaggaataatgagtgaatgtccaaacggggaaagctgcaataatccaaagacatttctagcctttctgtttgaacaccgatctgaaattaagactatttagaatatatctagagcattctttcactattcatttcactctctcggagtagctgatttgtttacccctcttctaaaccagaatcaggtaacctggtaactagttagtctttgagaaactcagttctaattaattgcttgattagtatttacatcatgctttcaaagttaggactaatccttgaaaagcccaaggatatttagctacatcattcatgcatttttttttatggttccaatgagtagttggtatactgtacggttttcttggctcagacttgatacatcactccttgaatataagacagtctacgggttttagagtagcagtgaccaccaaaacatttcaggttgtgttggagagtgcagtggatattttccttcttaaaaaggtagaaattcgttctggtgaatcaaacattctaagtgagctatcacatatgcagtactgatttgtaagagagcagatgaaattctatgaaatgcacttaagagtgaaaggattttaaatttgttagtcagtccttcataatcccaaaggttcacctgtgtgtttcagtgcctcagtgttgtccttatgagtattaactatcactctgctgtagattgtgtgaacatcctggtgtgggcagtgttttagataatcaagtgcttgataatagcaaacttgctctatgtagaagcactgaggaagtaaatggtacttgtggtctgaccaagttaatgtgcataccatttctcatattccaccagggagtctcttaggcaagggaaagatattgtgagtagattttaacaaaccgttttcctatcttttagacttctgtataatttggtgaatgtgcttgtcttgttttccttgaaaaatgcctatcagcccatttgtatatatacatgcacagaatggttggaggctgatcctgcaactcaatagatgctgcattctgatttttgttctaatttgactttggggaaataacttttgtctccacttcccatctctgaaatcacatctatctcactaatctctcactcaagagtaaatatgtaataaaatgtgaacagtgaatggaagacattgtgtttactattactcatgacttccttgttctgcttcacttctttcttgtaaaacaaaatattccttcaggttctttaactctctgcattctgggaaaagaggagatttgcagtctggcaaactcttcttgttatcttgggcatcactggataaattcgcctctctgaggatcagtttgttctgtataaaatgaggtttacaattcataggattatgaagattaaaagtatagtaatgcctagcacagtatttggactatagcatacgatcaatagattttggtgcctttagctaacaccttcttaccagttatcctgatactttcaattacctctagccacaatctttggcaaagtctctagataataccttttgtcatggttcgtgtttagtgctcttatgctttttatgggaaatatttccaacatttttgggcatatgacatttcagggttatactgtaggggtaatatacttataaaagatgttctctttcagaaatcttaaaaacaaatgcgatcttaccaggttcttgtttattcactcattcagttacctctcacattcattcattaattcagacagcatttattatcaaatgagcacttactaatttattcagcatatattccatatactttaaacacatgaatgaagtaggggctctcagaaaaaacattttacattgtcatttttgtatttaaaaatgtaaaatcacgcctgtaatctcagcactttgggaggttgagatgggaggatcgcttgagcccgggagtttgagaccagcttgggcaacatagtgagatcttgtctctacaaaaatactgaagaattagctgggcacagtggcatgcacctgtggtcctggatattcaggaggctgggtgagaggatcacttgagcccatgtggtcaaggctgcaatgagctatgatcacactactgaatggcagcttgggtgacagtgagaagttgtctccaaaaaaatttaaaaaatgtaaaatcacatttaaaaaattaccaaattatgtccacagcagctattgtctgcccctctgtctgtctctgccccttattctatgctgaccttttctagttttgtgtgatgtgtgggacatagggtcaaagtacagtgtgtatctaaaaagatcagttgaagctatagtaatgatgataataatatttatttgttgagtgcttaccattatcgggcagtgtgcttagtgttccatgaattttattccattaaatactcacaatattaatgcaggggtgatgccttaccatggtcataggactttaacagagaacatcaagaacctatgtctctaacctcatcttgtactctatatactcatggttctatgatgcactccttgaatatgctaagcaagcatcattttgccttaggactattgttcggttcctcatgtcagaaatgtcctctacccacatcctttgcttggttctcccaagattggctcttccttagttttcagctttcagctcagtgtcacctcatcagacagtagtcctcctacaccaaccattctgtttcacatcactgtttgtttattcttttcatcatagcttcactatcataaattatcttatttactagtttacctatttattacctgtcttccctcttataatttaagttacacaaaggaggaaccttgtcagcgttgctctctgtgggctttgcagcacctagaatagtcctagctagaggtagggtctttatataactttattgatgtatagtgtcacttcagaggaagccttagggcttggaaaagaaagagaatatttaaaaataactcatgggggaggggagaaggagaattaacatgtattaagcaactgctatggagccagaattgatcaaatgcttttataatatgtatcactaaattttcaaaatctcataggaaaatttcgattcagagaagttgagtaacttgcctatgatgacagttaattactgacggaaataaggttggaatcttgttctgtttaactccaaacctcatatgcctttcagtattttatatatttcaagctttggtgaatgtggtggacgtcatgattcactgcctagatgcccctttagtaatgaaggactcattcctctagatgctaggggttctgttgacagtcagccctcaatcattagtcctctctatatattgcctggcctgaggagaggggccttgctcaaagtcatgccccattcccatgattaatcaccatgtgataagaaagctaggccttcttgctctaatttaggcaactctgagatcagagctctatgtagggtcagctgagacttccattgagtcttcatcatagtccaacttctccttgtgcccaattctgctttcttctctaccctttcatggttgttgatcccaagaacactccctaataagtttcctgcatgctaatctccttcttagagtctgcttcctggagaacccaactcgtgatggtgagtttgagaattgtcatggcattaacaaaagtgcaagattcagtaatgggaaggtggcatttgggagaaatataatgatagctttggatttggatattttgaatttagtaaaaatgattagctctggactgtgagatctttaagggtttgtttactgaatgaccaagctcagttaagtgcctgccagttgatttaataaatagaggattgaagatatgggattggaatctggctaagagcttgtgattgaagatagttactttagaggtgatagctagtatcttgaaaattgacaaacactctgagagagaaaaaaataagaacaacggagaattagggggaaatatacagaaagaataaaaagaatataggtgacaggatttttttgtgtgtttgtaggatgggaggtgactgggagcagctgggagcaaggacccagtggttgatatttgcaaaataatgaaatttaaggatggtcttttcaaatccagtatgattgaggttgctagtggccttagaaaagcgatgccaatcctgcaactgagataaagacctatataacaaagtttaaaaagggaatatatggtgagtaaacaaaggatattgtcggcatacatctctgactcaagacatttgataaaaatagagacagcagcacctgtgaggccaaatctaagtttattagagttggaaattcatgtttgaaggtaaaagataagtaaaaaaaaactggagatggatgagataagacttgatcaaggatagggtctctttagaggcattctctaacctatttcctaagaatgaggacacttctttctttatactcaaggggaatgtaggaatatggcagagtaggagtacagtgcaaaggctactgtcatattttggttttattcatacctaatttattattacattcttgtctagattttgtcattttaacttagtcattggccagtaattttgtatatctagcaattatcacatttaaattgccatgcaatttgcagttctctagatatatattaatgatggcagctgcactgactatgggatgtcaaatcaggtatgaaatgtcactaattcatccttcagtaattttactcaagtcatggagagtacattatttcatttgtataatccactgcttacataacttttggattgtcttatcaatagctttagacttcgggttttctcctatcctcctaaaaataagcatttataaattgaacaccatatggagggaactgtttttttatttgtgtttgtattagcttgttttgttttacttataaaagtgttttatatatatatgtagttataaaagtttatatatttatgcgagttgtgtatggacacacacacacacacacacacacacctgttcttattctctccatgtctgatatgactttgttcagtgttagagctctttttgacacttttttgatactggtagaaaggtcactaatggagggaactctcgaggtattaggagccaagtgaataggactctattttgtcggtatattaaatatattttatactgttgaaaggtagtgtggaaggtgaaataaggccaaataggacatatgtcatcaaatgtagcttcttggctctctttccttttctgggtgaattttaatcaatttcatcaagcaaggatttatatctattttatgtactgcaaaattttatgactacaatatgcctggcacattgtggttgggcaacaatttttttttttttttgagacagagtctcactctgtcgcccaggctgctgtgtagtgttgcgatctcagctcattgcaacctctgcctcccaggttcaagcgattctcctgcctcagcctcccgagtagctgggattacaggtgtccgccaccatgcccggctaatttttgtatttttggtagagatggggttttgccatgttggccaggctggtcttgaactcctgacctcaggtgatccgcctgcctttgcctcccaaagttctgggattacaggcgagagtcactgtgcctgggcaataaatattttttaaatgagtaaatttagagtgaatgtaaagattttttttttaagtataccacacaaatgttgtaagaaccaaaaaagggaatacaaatccacttaagaaaaataaaatcaacaacagcaaaaacaaagtagaaaaacagagaatatgcaaatgtaaataattattatgtcctgttattttaatttttattatttcatatatttactgtatgccccctatgcatgcttaattttactgtgtcatgagccagaaccctaaatctgtggagcaaaaaatggttccagtcattagcccaattaaaaaaaatgtattttccttgaatgcttgatcttctacaccagtcaacttacattatatactaggaagaaaaaataagttctgtctacatgatctaattatattttaaagaaattcaatagtattttattaagcagatatttgttgtttctgtgccagggatttgagatgtctcagttatttggggaaaatacttataattctatatccccacctactgctctgctacctattttcttgtgattctgtttcaaacatttcaggaatgaaatttcagaaagattttatctttcttccaacttctttcttgtataaagtcttcccaagagaaatccagaacttgtggaagaaaaattcatattaccccttcagcaaatttaagaaaaacctgtcattgtactagttagaagcttattatcttaattcagtaggtttatgtagaccttaacaaaaggaaataaatatcttgtaatgagtattgaccaaattctctcagtgcatggtcactctgagtctgtttgccttcttccaatttcatttctttcccttgtgtgattggtttaatttgtgtatgaatcatgtcttgattttaaatgttgtcttaccaattatttgctttttggcttaaggagtttgttattttctaaaaaggaaaggatagagagagtcttacaaattgtgtttttatcatagtatttacacatgtaaacccaaatttattttaataggatatttgaaggatctgtatttatctatttatatctatgtatttatctaccaatctactattgatttcatagggcaggagagagggagagagatgaccctgtcattagattctgaatttaaaagtatcacataatagaaatctggagtaggtataattacccttattgtatctttttaaaatttgccacaactaatgaaaatgtcttttacttccttaacaaaagaatatgcctccaaaggcattgttgtagggagtgataatgatgagatgattgggttgtaatggaacagagatggagggaaagagtaaaccttagatacagactattgtaattccatttgaagcttcagacagatatgagggagtttctagtgtggaagttggagaagagagatttattgtttccacctgacataaagatcagtaaatgctttgtggacctgacagtgtttgcaagctataaagtctttctctctttttctgtgttaacttattgccattgtaaacacatttcaaagaaaaccaatcttcccctttgttctgaattaaatttttttctccaaaagtatacctgcaatttataaacctaactttcctgctgaaggagaatggatgggattctccagcagcttattgcaggtggctaactatatgaattgtggtggaggaggctgctgcctactgattttctaaggacttaggcactttatctccttattcagctgcattcttgggttgcgggtgagggaaaaatggaaggaataaaatattaaattaagttgtaaatgtaattttctaccatcaatctagctttcttgactgtttagaaaaatctagataatctaggtctcaaacacctagtgaacacaaatatccaattgttttgattatacaggtggaatatatcaccttaatggtgctaatggcaactatagtgatagaaattaacaattccattggacatgtaattggaaaaagtattgtactacaagttaccccaagaaacatactttttcaaagaatatatactagtaagtcactttcaagtatgagtcaacgaaatattaccaattgtataactataaaatatgaatccgctaataaggatctacaaataagatcaaaccaacacattttggccattagataaggtattcagctactttgtgtgattataaatccacaaatcttataaaccatgtaaagatgttacataacatcaagaaaacatcttaaaaacctaaaataacaaagtttattatggttttgctcttccagagtgactaatagaaatgaatcatgggcatattaaagtcaagcctatcagtttctgccttggtattttatactagttcaacctctgatatattatggattaaggttacgaaaatgttaagtgggggcatttacttttagtaatccttattctctctctctgtctttattcctgtatcagaacctcatgccacaaaaatctgctgtaagactctcccagataaattgtactatgtacattttaaatacctaatgtaaaattattaattcaaaagaacctctcttgattgtaaggacctgcataggagtggaaagtaacctttttggaggaacatggggttgtgggtgggatggagatagctctcctggtgctcctaaaatcaaatctagtgtctggccccacaagactctgccacgtagtgatgactatatagcagtgatgcttctgggatctctcagtcagccatctggagatctcctttgcgacggtaaattatttaacgttcttggtctgtagtgataacatggatacattgggaagtaaaaacaaaataataatatatagcatttttgatgatgtggcattatacttttaaattttggattataaactgttttttttttaatgaactattactgctactttagggctcattttaaataaggttcaggaccaaatggggctgatgttgtccttatgttttataatgcttagagattccagagattttgctatttataggaataatttatggattaatatgtgttgtggtaataatgcatgccccatactgggtttgccttggaaattccagttaagagtcgttatgcatgcaaggaagttaaaatgtttttagaagctggaaaatagtaagtgatatccaatcagtaccttcttttcaagcatcataacattaaaattccggtgtgaatatatgcacatgcttacttatataacttgtgcaggacaacgtttgacagatatttgtaaagctgaatggtagagcaagatatttaaactgatgtaatatctaggaagaatttgaaaaaacatgatgccatgtcagaaacatttcctctcctctgtaagcagctgttcccaatatccctttcttattcacatcctttcaccctctctctctccttttccaagttactaattttccattaggtaatgagacaaacagatggccagaaatactacatagtttacagtttggttctcaagtgagcaagttttgatgtcttttgctggaggtcttcgaaaatgtcccccacaacaattcacatcatgatggccattttgtgataaacagcttattttgattagtttttagagtaagcagatttgaagagaattttgaaaagccaggactttgcccaactatactgttttttttaacacctaaagatacaaggcattagtgacatcactttatttttttcttttcagttttccccacctcaggactgtgagagattgatgtgcggatacatactttccctacagaaaagacagtagcaataagtgacatctctttagcgtttctaaaacatgtttttcacatacattatcccacttagattcacccaggaagtatatgaggtaggcaggacatggattcttgataggcccaatgtaagggtgaaggaaccaaggcccaaagttggtaaccaccgacattttagtgcccggttctcctattgcaaaccctaagctctttctaccatgctattatttctcagcatagccacgaagaggtctaaccttaatatatagtcttgctcgggtggggggggggggttccctatcttgcttcccctatggctcctactttgttgacttgttaaggagtggtggtagcgatttttgtgggccttgtacctcttaccagttgtttagttccagactgtgtgatgagtttacacaacataggcctgtgttagaaatgataaagggctctttcttcctcaggattctgcctctaggctgacctagtttgcctgtccgctgtcatgtttgtatgctctgggcttctgtgggtgaggcagctaggagcaaagtgacaaaagccactgatactgccaacagcttagtttatgctatagagtgcgggaagaagaatgacattacctgacatttgatttctgaatatgaaggaagtcttgattatcagataaatagttacatgcataagggtatatatttctctacctatattgtatataaactatgcatacccatacatccatgtatcttggcataaataatttattagaaggaatgaggaaataatataatatgtaatagagtgatagctagtttaaaaaatgtgctcagatagtttagagttaaactaaaaaagactttttatgttatgcagtattaatcttctgcctgcatgaattttttttccagaaaaagtgattattctgtatctctaacttaggaatctagtgcatcatagacactgatgatgtggcagtcattatctgccaaacatctgcctagtaagcacgttttatatccgtttggatcatcagattatagtcaacactagatccaattatattcagacccttactgagttttttctttcaagagaagtggaagcaatggagctaggcaggacccaccctgagtagtatgttgatgatttctacatgtctcagcatctgagacttttaaagtccaaggacgtgttcttgtcagtgtcctgaaataatcagtctcttagccactgactggctaaacaaaatgcccatggcactttggttgacatgtaaatgatgatttacttatttacaaggagaagtaactgtgaaatgtgtcttattactcaaaatcttaatgctcagcacatttcttacctgatcagactatctgaggaaccaagtcataattagaagtttgctttaatccatttagagtcaaagcaaaattaatttcatgctaagttctttaatccagtttatagagctttccagctgtagggaaggccttgccagtgagaactgatgttcaagggcattcataagactcatttttagttaagatggttgaatcatttttcttactttagggataatctttctcactgtgacagagggcccatatgctcctaaacagtattagatataatgtttcataaacaattcccctccccttctttttcctatgggttgccatctctaattttaccacttcctccatatcctccctttgttggtcacctttagatatgttgcttctattgctcaatggcctactttgcctggagtgaaacccaggcatgcgactggagcaaattctctgccactggtttacaaattactgttcgagttagtgcatttagggttgacagcatatctctttgttttatgtgttaattttataatttaactgtcaggcagaaatattacttctttattctcagactcttcttgggaaataccccactgaaactcccaagtactgggcacaatagagaattctttggaaatactcaaattgaagccacaaaggtgtctgaaagactagaaatgattttctcatgagatccattcctatccagtagggtacctatgagctgaaatgtcactaattagctttgcagcatttactaattggcatctttgggctgtaaggcatggctggcaacagtcctagatgttagacatggtcagtttagttcaatttagcaattttttgactacttcataatcaagagatttatacattgagtttaatcatcacataacacatatttgtgtaatactttatagttttatttcattttgatctttcaacagccctgagaaaaggttattcaggaattttcccattttatgaaaattaaattgaggttcagaaaaataaatcctgtatcccaaatcacacaggctagccaggagttaatccctttcaactataatcttttctgctgttggtgaagatagaacaatgtatttcagcttagaagggcaggttaaggggttggagattttggagggagtcagacctagattggattgtgactcagacacttactacctaagtgactttgggcaagttttttaaacttctctgggtttcattttttcacattcataaaaccggggtaatacttctgactctcttgtaagattattttgaacatcaaattacttgatgcatgtgacacgtagggtccagtgttgcactcagcacaaagctggttgctattacagtgaataacccagaaagcttccccattttacactttgaagactgaatcagccctatgccatctgtgaagttttgtttggttttgggctttaagatggaagccacgtctaccaaaaggcttttgctataccatgatccattttcctgagaaaatgtctaggagcagtgccatcttgtcttatcatcggtattttcattcacactgaaccaaattggccgtgatggtgaccagtgaagcaagtattaatatctcctaaaatctcactattaagaagttaatgagcatactggacctatttaagtaatagtgacactgtttacaattttgggaaaacaacaatctcattttcattccattaaagacaaaaggaaataaggaatttcagttagatacatggtaagtatttcctaatggtcaccaaagtgaaataaattaccaatggaggatgcagcttgtgacagaaagagcacaggagacccacgacctggtcttgatggtgttcctttccagttctgtagctgaggcaaaacactttaacctctctgatgctcagttttttcattcgtgaaatgtggataattaaatctgagactcgtgagattgttgtgagtatctaataggatggaaaaaaaagtgatttgtaaaaaccataatgtgttatgcaaaccgaaggtggtggtgttactctctggagttctttgaaaacatcagacatccttggatgacttaagtgtgttcttgcctgaaggcagaagaaagactaaataactcatacttcagggagtgtatgttttcagctcaaattagtattgatggtattaggttttgtatcaaattgaaattcaatggctatttttggaaaggcattaaagtgatgtaacaaaggggaaaatactgggaaagcaaacatgcattttgtataggaagacttaattacaatattgattatatgttaagtataatcaattataaccaataatagtgatgataaccactgtggtttgctattagagcatacttctaataaggcaaaggttattagtttgaatccccagatgggtcaattagcataatgtcaacatttaccccaagctctaatgaggtcatgcaaatatatacctgtgttcacaaggagaataaaatgaagactggaaaaaatggcccagatgttaaaccagtatggatagaaaaaccctaattttagtgcatctctagctttttattttttcctttagcacccctaggatttttgcattttgtaactaattatctgaacttctagttttgcttagcaaattagtgttgtaggtcacttgaaatggtattcctaccttcctataaagctgctatccttctaaaaagtgtggttatgattacccagagaaggttgtttaaccgccagtatgttccaactctgtatttacgagtgcttaaactttgcagtgctgtacttgaagatgaccctgagaactacatacttcttacatatgtttttcggatgggaaaattgaggcttttttttcccccgaggactttcaggtgaagagatattggctaattttattttttttaaaaaaaggtcagtagcacagctggatttgtaatatagaggtcctgactcaaagttctatatttaatttgcagtcttttttttattttttattttttggcttatatgtagtaagtttagtcagaggctgggaaagtaaacattatgtctggatatctagcaagattgatgactacacaattacctctccttcagaagtaaactggttgtttgaaatgacattatttggattagttttagtgataaagtcagttatataatttgatccattggtgtctacaggcctacctacaaagaaagcatatctaagattataattctgattaagttgtggaatttgacatagggtatcctaagaaacaatgtgttctcatgttatggagaaggtggtgatctccactttgtgacctggaggatgatgagaagggttccttgtccccacaatttatctttctctgacaagcctgtttactaaaattaaactcttaaagattccaaccatcttctatattgtagagaagctcattcacaccatcatttaccttagcaaggattcaggcttgaggttttgagggaatggagttaggattcctcttgagcatcatcttagaacaaggtagtaaggggatttggaattttgatgagggaaagaaagggaatatgcaaagaatggcttttggaaagtttagattatggtggtgaggatctggcctaacagaaaggaacacaaagacgccgggtgctcagagggtggggaaaggtgagctagaggatgacagaaagctaagaaaggggaagtggaattatttaaaataaaatttaattcctgattttgcttataggttttcttgttgatatggctttgatttaaagaatgttgtgtgttctcaagaaaaaaatcaattgtttgaatacacgtgattttgtaattttatgtaacattaaaaaactacttacttattgaagacagtttcctaagagatgacatgttctggccgggcgtggtggctcatgcctgtaatcccagcactttgggaggctgaggtgggcagatcacgaggtcaggagatcgagaccatcctggccaacatggtgaaaccccgtctgtactaaaaatacaaaaaaattagccgggcatggaggcgggtgcctgtagtcccagctacttgggagactgaggcaggagaatcgcttgaacccgggaggtggaggttgcagtgagctgagatctcaccactgcactccagcctgggggacagagcgagactcggtatcaaaaaaaaaaaaaaaaaaaaaagacatattctttttgtacaagagggtttctttacttttcgtcacgtgagggtgaacagattacctaatctctctaaattttgttcttttttagtgataataacaccagtctgattatttcacttgattggtgcaaggatcaattaggataatatatattaaaaatacaaactgtaaagtgctcaaccaaataaaaaacattaaatattgtgtgcagtaaaggttgaaggttacatgcttagatttgggagccatattacctacctgggtttcaatcctggctttgtccctttttatctgtgtgacacagggcaacttaaagtttgtgtctcagtattctccttcataaactgtgaaaaataataacacctacctcatgtggtgatgtgaaaatcaaagaagttcatatacatagagggcttaaagcagtgcctggcgtaaaacacggtagtcattctagctgttgtatttttatgtgcatgttagcacaaaactaaatgctgaattatttgcatgggagtgggttactgtgagattaaagaaaaaaatctcgtatttatgcttcaagcagcatagctctttgcttatctaacaaattcatatttgattataagccattagtgacagttaatgaaagggactctgtttgaattaagcggttatgagtatccatctcagaagcttacttctcttgatacttgaattaagagcctattctcattaatgccgacttattcagataaagttcacagtgtttttgtctttttcatcatatttatatcttaagtgaaaggtttcaaccgtaacgacacattggaagcaactgggtccccccgcaccaattcaactggaaaatctgggggtggcacgtagaccttggtattttttataaagatccccaagtgattttaatgtgaggcagaatttaaaaccattggcttagagcagtagtgattaaatatatacctacattgtttagtttctgaccttgatagatatattttgtcatatttaaataaacaaaataatggccaggcacagtggctcacgcctgtaatcccagcgcattgagaagctgaggtgggtggatcacttaaggtcaggagtttgagacctgggcaacatagtgaaatccccatctctactagaaatacaaaaaaagaaaaaaaaaaagccgggcatggtggcacgcacctgtaatcccagctcctcagtaggctgaggtattagaactgcttgatcctgggaggcagaggttgcagtgagctgagattgcaccattgcactccagcttgggcgacagagcaagagtccatctcaaaaaaataaaataatatggctctttatggatgtttctttaaaggcagacctattgtttctattaagtttgtgtcttgtgagtatatgtcactaagcagaaatgagaagtttgattgtttttaaattatgtgtgtggctttttttggcatgatgaagtgctgtgtgtatcaaataagaatatagactttcagaatgtgaaaggtaagagggagcctcaaaggcatctagtgcaaaaggatacactttgaagtcagttctgttttggagtgatttatttacttactgggtgtgtaatcttgtgacacttgcttaacctccctgagctgcagcttcttcatctctgtaaaattgagacatacatgtattttgtgcgatgacaactgtgtttcacgctgcgcgtgcgcgcacacacacacacacagagagagagagacacatctttactctctgcctcctgcctgatccccgcaccatctggtgcagatatccagagcagggactgtgtgggagcctcagcgggactgtctgagcctgcagggccagctgctggggactgcttcctcccactcttcagggatcatttctctggctctgttgggactatttcgtggttggctgttcggatctcatgacctttcttgagcataacatttagtctgtggggttcagtcactgttggtcaagtatagtgaagctgttagtgagactagagatgaagatggctttttgccgccatatgatggaggcttttgggtaccctctcttggtacccactgtttgaaccacagaaaatatgtgtgcaggacactgatggctgcttcctctttccagctggcttcctctccattgctagtttgtgttgatttgggacactaggaggccactatctatgtcttagtttgggggaaggagagaaaaattacagacctcttgactttctttttatgatagtaggaacagtagattttctcctttcccaccctcgtctctttgatcctccagcatagggctataaaattagtaggccactcagcaatcctgttgcacattctttgtatacaaggaaggaagttcatggttgtttcttattagctgtaaagtaaatgcctggggtcttgaccttagctatgatgtttcagtgtcgttcctactcactggcaggcctggctttagtactatcctcagccttaatattgagaattctgcttgtatcactgtctctctcaactgatcttaatgtttcattggaaatatttataaatctggctgccatttttctgaattttcctctgttcactggaattggtgtcaacttctcataatgagaagtatcggtagctttattgattttttttcgatgatgaagatcttgaaacattacacctgtgggatgagttttctaattgaagtctgtgttcctacattagattatgagactcctgagggtaggaaccatgtttttcagcttagcatagccatatctctcatttattacacaccgactgtgtgtcagagatgttgctctaattatttcagtgcattcccataaaaataaggtacacatatgtaacaaacctgcacattctgtacttgtatcccagaacttaaagtataataataaaaaaattaaaaagatcatttaactaaaaaaaaaataaggtacgcataaggaatcttgtttcagaagagcttaagtaaattgcccaaggtcatctagctagtgagtcatagaacttgcttttgaattcagtttgactttaaaacctcttttctaaatcatctttccaaactccttgcagaaaaggacagatgcacataagaggactgggatcttggcctgtagaatgttggatggttctcttaagtaggagccagttatggagctgcattcttaaagaagaggatagacagtctgcatgttttcaaagcccttgttgttcccactgatctacattgacttgcatcactggcatacatggacacttaataaaagtttgttgagagctggaccctaccaccccagaggcagaaatcatctgatggaaggctttggcccgtttgtgggtcttcacttcatgctttttactcaggtcagagaggctgagattatgtgaatttgtctctcactgatcaggccatgggttgaggccttcagacacactctgaaaactggaatgaatccatggtgataagatattcggaggggccagggctgtgttgaagtcagtcttggattgctgaagttaggagatgctgtgcagtcagcctctatgcttgtggtttaggctattagaatgtgcctgcccactttggcaagaaataggaagtgcataaatgctttatcaacctgaagctttgttggatgtgctcagagaacatttctttttaatgtatgtggaaactataaatttaactcctgctgggagtggaagtaattgcttcacacaagaaaaaagctagatctttaaaaggcttaactcctttcacaaatatgtgctttttaatgactgggaaattcctggtacagaaaaaaaaatgtccttttgtacaaatgaggtcattctggtcttaactggccctgtacactctagttcctgctttctgttccatgttttatgaccagaggttattggaaggatcatccctctgtggatatccactgccttttcagtttgttgccaaggggaaagttatcttagctcaggaactgccaagccagtgcaagaggcccagatccaaggggtactgagctagtgactgatgatgattggatttagattggtcatggactaggttgttaaagcatgctttctgtgtgcactaggatcactatgtctgattcattctctttagatttcttaaccattccattgcctcttcgttcaggaatgatttttctttcctaggtgcataccatttactctgctttgagtctgtttggatgagtagaaacatttgtgccagtctgaggcctggtataagtgaaaagcagctgctgaaagaagttgctctgtacctctcctttgaacacttggaagctgattcctcctaaaattaatttgtgaattggtttggctaatgtgcagtaggtatctgaggccttagatttgtgtggtgaaagggttctcctacgtggtaatgtagagtagatctcagtagatgcccttgattcaatttaagctcactttcctctaactttaaccattgcctaccaaggaggatgttaaagattcgaagagtgttaggtagggagagtgttacatctgtcttggatgtttttatgaagaggtggacatggagtgggtctaagtgagatttgacatagacctctggtgtctttttttttttttttttgaggcagagtctcactcagtcacccagaatggagtgcagtgggggtgatcttggctcactgcaacctctgcctcctgggttcaagcaattcttatgcctcagcctcccaggcagctgggactacaggcatgtaccaccatgctcgcctaatttttggtacttttagtagagacagggtttcaccaatttggcaaggatggtcttgaactcctgacctcaagtgatccacgtgcctcggcctcccaaagtgctgggattacaggcgtgagccagagtgcccagctcctggggtctcctttagacgatatatttttaagacagccactttgaaggattagcaattggaaattgatacttattaactgcttcttaggtatcagcactatgctagaccctttctgcagattgcctttttagaggtagaaggctaccatgctgcctcacatcttgaagggtttgtattacattcgtattccccaagaattcatccttggctgtaatggatcaatgctttgatgaggccttgagtgctttttttctgcttaattgactacaggtttttgttatttaaaacattctctctcttgctactgagaacttggttcttcttatcataacttcctaataacatctaggttctaggatcttggtgtcccattcatggctctctaagtctgaaactccaagttcagtctctgttgcttaatttcttgatctgggattaagaacctctgtcttaagccatcgtggagaagagattatgaaatgtggtcatgagctgcttagatatttgttgcagactccatattttgcctgaagcacttgtggcccatccagtatgctccagaaagaacctttgcttgaattctcttgggacatggaggaagtcaggctgactgctgtgacagtcatggctgtggggccctggatcacctgcttcccatcctactctgcctttttgttagtctcctcaaagaacggggaaaaaaatatcatttaagtttaaaaatatcttttattataaagttgactcttttaactcaatttatcactgcttgctagaccatccttgaaaaccttgttaaaatgtagaagaaaatatgaagacgtgccatttgatttcagttgctcattacctcatgcagattacatatgctggaaaggaaaaaccgtgactcatgtttctgcagggcaccctccctgctatccccagggcctgggtttattgtaggcagccaatgtgtattttattgaacttaatagctgttacaaaagaattgaagaaaacattcctaggaaatactatcataattgaaattgggaagttctgggtaattgccgagtgcctcatattagtttctgtggggaaaatacatggcatgatgcaaaatgggttaatactgtagaaggaaaactctcaagagataaatcagaagcttcacctgtctgcctacgatactcacagtgggaatggtactgatttgctgataatatgtttttattattattattattctgtagcctcagacgatacagcagactctcaagaggacactgcagtattatgaacatcaagttattgggtaagtaaaaattgatttcggttattattggggacaaattaaaggtaattactcaaacatagctgttgagtatgtgattttctgctacccaggtcaacctgattttatagtggctatgttttcatagtgtggggcgtgaaggcttattgggggagtcccttggagtgatttcttttggcttatttgtgcttaattcttttaaatgaaattactttctggtattgcttttcttttttttctcagtcttctcatgttcttactcttttattccgatgttgaatcatataattatgccttactaatgtggtgagctttattggtaccaacccagatgctttgaatgggattttagaatccttaagtagagtttgataagaatcactacagccttaacacagttcagtgagaggaattagtttacttagagtcacgtgctacatatttttctttattatcatctatttcttgaagtggttgtgatgtggtgtaaagtaagaagacttgatgtcaaaagacaggacttcaaggcctcactagcaaatagatcttttactaagtaactttatctcttttttaaactgtgatgataataataactaaatcaaggattagatgtaatgattaaatgaggtaatttcaatgaaagcattttgtaaacagagagctccaaatgagtatgaggtacacctctaattggctgtggcagaaagcagctggcaagtatgaaagcctaaatttacctactcatgcaatctagcttttagattaaatttattgacattagaggcaatgtatatattttaatttaccttgttagtattctttatatggtacagtgatttatctttgtaagattttaagaacttttgagaagtcaagattcaaactgtggtacttcttgaactgctctcaggatcatttaacatttatggctaatagccattgccatagggatcaataacataattttgattattacggtatagtgtgatttttttttcacagaacagaagggaagaaatcttaatggaaaaataatctcggtacctagtacaatgccgtatactttaagtgcttgatgattatgttaattgtcatttaaaagggaattgctttgaaactttgtcatacttatcctcaagagtgtagttctaggaaaaacatattatttaaactcatgagatggcttttagtttgaggccattagtgatttaaaatggtttatcctaatggagataaagaatgtcaaattaatctttctccacatatcctgaaataaaacttaatcactctcattgaatttgccgctttccaagtatggtgtttggattaaattagttagtatacttaaaatagttcctcgtatgtggtgagcactacatacctgtttgcttttatgtttatcgttattattaatatttttatgacaatatccatcatcaaagtctaattttctgggattatgaatgctctttcgctttcgaaataaaataactgatgaaatattctcatttttgaactaaagtataccttcaaggcaaattggagtgggactcttataatgtgatcaaaatagataaccaaactatattgctataatcagaaaagttttttctccattgatagaatggagggagttcccttttatccagctggctgcctcagccctccccttctacctatgtagacatggtctgtggtgcttctttgtctattgcatgaatggtcttttcctagttctgtttattgcatacacagtataaagaaaacagagagtttgactccagtataaagaggggtcttgatgtctggcatgattcaaataggcctattaacatatttttgcttgggtgttggctgatttcttggacttgaagtacctttgctcactgactttatttgcattcatgctgatgcagacaaagggggcctgttggcagcaattttgtcacgtttgcctttcttgactgtattcccctttcttgccttttttctcattgatgactttcctgtccaacttcctcttttgccttttattctccatctttctactttctatttctcttttcacaatcaagaaagcagagcagctaatatcactcaccctcgaactaaaaagtgtttacagctgtatgttgttcctcttaagaaaatacaatttaaggcttcctatctctaattgtgaaaaagaatgtgtttcttacagttaaagggattttgaaatccctgtattgagaattgagagtaagtgccgacaagcataattttagttattttttggcaggtgagggtgggaaggagatgcttttcctaatctctgaaatggggcttgcttaaagctgtcttgaaataactcagcatttaaataccttgtgttgaggtgttgaagcagaacaggtaacagagtatgagctagcccttctctttttaatttcttaattatccttcaaccactaaccttcttttcctttccttgaaaactctgcccttaatctgttttatttatcagagctctaggattgtacggttctgctccttggattcttatactggttgcccatagaaactctctgaggctttttgtgtctgccaagactgagacttcaacgcggagagcagctgtttcgaagggtcacagacagaaggactgggagggagtagctgatggggcttcctgttagggagtaagatagcctctctgtactttatccactttatctttaaacattattctgttccttaatttatccattcacttgttcatttatttattcatagagatcattcaagttggggaaatgagtgctaaaataatttattcatgcaatgtgataaatcttctcttcatctccactatcgtcatcatctctcaccaagacattctggtctaattttctggtttctacttttgtccgccaatatgtattttcaccacagcaaagcaattaaaaaattacatcatgccaccttcttatgtgaaaccaatggttctcaaatgttaatgtgcatcagaatcacctgccagccttgttaaaacacgtattactgggccctgctcccagaggttctgatttcctaggttcagatagggctcaagaaactggcatttctgtcaagttcccaagtaatgctgatgctgcttgtccagggatcacactttgaaccccctgctttaaactatatgatggcttattatggtagaataaagtctaaattctttctgtgatctggcctctgcctacctctgtaatttcatccctttccactttcctttttttcactccatttcaaccttctgttggtttctcaacttaccaaccttagcttcagggcctttgtatgtatcgtttcattcttatgcaatgctctttccccagatgtttgcacggcttattctttatatacatataggtctctgttcaaatgtcttctctacaggaaagcctgccctgatcaccccgtctaaagtatctctccatcacctacctcaaactccaatcgtgtcaggttgactttgtggaaaattttgattactatataaactctacatattcatgctcacttggagagcttcttgttcccatagcactgtctttcctccacctagaatgagcaagggggcattgaatgtgcatctttatgttagttgctctttaactcaaacttctagggaatggactaactttctgggtggtgtggggtggaaagattagtgaggagcagaagaagtcagtagcagacaggcaggattcactttagaaattaaaagcaactgaggatagaggaatgtctgtttataatggtactttttttctgatataattcttgccatagtgccctttcttctctttgtatgttgtggaaagattgtgttttgtaagtagacatatgaaacttactagacatatagtcaggttttgctatgaataatcttgggaaggttacttaaaatacctgagcctcagttttctcattttaaaaatgggaataataacagggttgtggtgaagtttaaatgaaatcttaatgataataatgtatgaagtcatataatcacataaagtagttagcatagtacctggtacacaaagataatcaataaatgaattgaattattattactactgttagtaaatgactcttttgcaattcaacttttgtggattgtcttcagtttatcctcctgctgcaaccttttcctgtcttccttgggccttttaaagtttagaatctgttgtttagcatctggtggtgaacatgcccagttcgtgttctaactgcagttttcttctcacagagaacatctttttcgttgatttttttttttttgactgaaatttctgtctctagagggcttgacccaactgctctcactcatatttctactacatgattcctactggtctatggctcacaaaaatggattgccatggcagggtagacgaagcacagatttcttcagtgaactactatgagagatgtgataatctttctgagatatagtgttcactcactatatattttaaacaataaagaataaagaaatatgtattcagaaccatgccagtaattttatctttttttttttttttgccagaataagcattgctgtgttaatatcatggataggactgttgccaaactcatattagtctgggacaccaattcttatagtcatctaaaattaaattgtattgctccaattattaatgtgggccctatgtttgttttatacagccaaccttctgttctctttttcttttgacaattgaggagaaattaagccagaataatttcagtagaacactagagtgaaattaagaatgggtgaattctgattactctgagaaacaaacttcaaggatattacttaagctttcatgatcagattttgtggcttattttaatctaaaaatgatctagcttcttttttatatatttacatagaaaaaaactgtatctttttgaacataaacaaattagacaaaagctaatatctcttgattgcttactatgtttgaggagatatgctgggcactttccatcttttatttaatcctaaaaatattgcataagagtactgtattaagcacattttacagatgaggaaattgaggttgagagaaaaaagtacttttttaaggtcattctgataaaaatggtggaggttgaattaaaaataaccctgtggggttgcctgtgtttaacatctgtgctccctgttccacctcttgagtgactcctgcattctggaaactgtagtaagcattttgcctaactggtttattggagtctgatctcaatgaggtgtacaaacatgaaacctttttatttttccctccactcacatcaagcatgctaggatacatccccttcgatattagcttagacagattgctctgttttccaagtatttccaagaattatgaagttcactctagaccaatttaaatttttactctcatatctagtctgactctaatgttgctttctctgtctgggtcaggacttggcctaagagacttggaatacaggacagagtgtatgatgtgggttttcactcctcttctccaggccattcttttctgtgtccctttctcttcggatgtattgggtgaggcatgaatgaaatggaaaatggaaaatttcattggggttgtagcagtcctctcttggctgtcatgccctcactagggtgcatgtatgagttccgccctgacacttttggatgccccagctcctgcacctaaggacttcactctcgtggtcttgctagtgggagccctgtccctggctggcagcctctagattggaagagcaccatgacaaccagacaactcaagcttgcctctctcttccctaacccatgggaaattcacatatttgccctgccaaacggtgggcctttaggttgctcccaattttgctctatttcttttccttgtcgataactttctccagagtcttcttcctcttatcagtcagacaggggagtatgatcaggaaatccactgcctctgcagatgttcactggggaatgagatgggtaatccccaatctctaccagctgtggacccccctcaccaactggacttctgcagggaacactccccttttctccttttctaggaggggagggggaaaagtaccatagcactctcttcctaggccaactcctcactcttctgaagattttattttgaagtctttctgttcttttgcttctgtaagctggtggtagagtgacaggggcagtggctgtttagtctcctcttaagtcctgaagaagagctctggtcttcttggctacccctttggaatgtgggaggatttggcctttaatgtcctcagcttttttgtcttagctctcattcagaggcaactcaaaaagtcccagccaatatccagttacaggcattgtgttatttagtcctcacaagaactctagaaggtacctccattttatgagagaggaaatttagactaacagagattaggttacttgctcaagatctcacagatagaaaatggtaagaccatgactcaaattctgccaggtgtatgttatttatacaccatactgctatcttcttctttttttttttttttttttttgagacggagtctcactctgtcacccaggctggagtgcagtggcgcagtctcggctcactgcaagctccgcctcctgggttcacaccattcttctgcctcagcctccagagtagctgggactacaggcgcctgccaccacttccggctaattttttgtatttttagtagagacggggtttcaccgtgttagccaggatggtcttgatctcctgaactcgtgatctgcccgcctgggcctcccaaagtgctaggattacaggcgtgagccaccgcacccggcctatactgctatcttcttgactgtgacaaaagttatggtgtgtttactttcaacaccattgaatgccaggacaccaaattaacattgttaacttttccttttctaggcagcttccttatagaaacagatcactagccttgatgaagtgctctcagagtgatacattagctgtacaaagctgatatattttttgttctcttcaatttttttcacacatagctttcttgttaacagttgcctccagttccaggtctacactgcaaatgctgatgtgaatggtgggttatgccagaattatgtctcaaagcttcacttattttaaaatgtgactatgatgaaagcatagactgcgtgtgcttgtgcgtgtgtatatgagttgcattcgcagatgctttcaaaaatttctccttatgctaattttgttttcttcttagttacagggatgcagaaaagaatttccacaatatctctaacagatgctcctatgcagaccactccaacaaagaagaaattgaagatgtctcaggaattcttcagtgtactgctaatatactcggtatattaactatatatatttatatggatgagagagaatgaaagagagggaaagtcgaggtggaagtgtttcatgttctaccaaagagagatgtggagaatatggcaagttgagacccagaccttgtgaagtgatgggtgttaactctcctgaagatgtttgagtggaaattgcttgcatgccacttacttagagatggaaaaacatcaaaacaaaaatacttaaattccagggaaacaatttcagatattcacatgtgaatagtattagctctgtataatccatatttctttggcccttattctcagctaaagttgtaggatctttttttcctctcagtcatactctattacttctgggaggtcctggttggggcagaagggtggcccacaggtactgttaacactctacaatccaatgttcctttctgtggccttgtcagtgaagcaggtcatctcctgaggtgtctgtgccctacttggggttaggggagtgtccatcttaaagatatttgtacttatgacagaggggctgtttttggatgctccaacatggctaaaaggtactgttgtaaattgcagccaattatacagccgtaagctaccataactgagctgtactaccatactacctgacgttcttggtgtgtgagagctacattgtattccatgcaatgtattctaaaagaaatattttttttcctaatgtcttacagatgtttctagtgagaaatttctctttaagttctttttggaattcttttttctttatgacccagataggaatccatggggtgctggagggtgctagtggggaataataaatcttagtgagcgactccacacagaatgcagaatctcttttggggtcaggtgatggacaatagggcaaaccagtttgcatgttctttcttttcctttatagtattttccctggaggcatctgagtttctcctacaaacagtttccaggttaccccaacccaagggtctatcagattttctaaacatgtcagacttctagaggtagacttcttttacattcaagctgggaatccagctgccggttggctacattttcatcctaggtaacttttgtaaacacaaaattgtataataagaaaatgtataccttttgtgaggggatgcatatagatgttagtggtttgtctataacagcatgcaggacagtgatgggtagtgaaaaggaggccaaagattcatcaccttaatcttagaacaactgcagggatgtcacaatacccaagtaaatcttatgactggagaaaataagggatgggattaaaagagacattacccaagagttgtttaaagttttctgattttatattttcaaggactctcctttcagtaacatacatttctcttaatgcattgtgatttcaaggggtggggtgatgatgccacactaaaagggatgtatcagaatctcagtgaagggatgtttaatattttgagaagttgcttcttatccagtttctaaacactttcctgaccctcacgtctttcttctttatgctccctatttttagaatcactgagttagagggaataggaggtgttcaaagataatgattatattggggtgctaaaggcagttggactgtggcttgtaaatgagtgtgcacaattcccacggagagaaaccctgggtcaatttgaaatggttttcaggggacactgttggcccagcacagcttagttgcccttcgaaggttgccctaagatgttggataagtagtgagtgagaagaacagcaggcagtgtgctgcctgatgacattagggtgagtgcagtgtttataacttagaaggtgatcatgtaacagggtttagatttccatgaatagtaactttttctacaaaagagatactaggtctgattattttcttcctctaagtaatgataggttgttttcaagatttaaagcacaatcttgtaaagtttaaatttctgaagattaacattaacattaacatttaatgcctgccacctgtcaaccagatgctggcacagaggtagctgttctccttgaataatgtctttttagaactcttgatatattgactctctgaggacagcgttagcggtcatattcaataaaagctttgtttttaagaagtcactgagctatgattaatcttggcttgtttagatttttatctttttttaaagttgtgtttaaattctcttctgtaatcatatatgagaatgaaagaattggtcagcttactggacagaaaagcatgacataaattgttttttgggaggttgttggggggtggcacaggaaaacaacatttcaaccaagataagaaaaattttgatgcctgggaacctttttttttggatggcagaaggcagtgttccaactccatggtttatatttatcacctttggggagtgtgattagaatattggtggactgagattggcaaacatatatttctcttaccttcttaacctattacagggttgtattagagtctggaaatgtgttcgtttattcacttatttgtatattatttatacttcatcatcaaaaaagacttgaagtcatagatcacaagatatgatcatagtagcaatttttctccttccaaaatgagcatttctacctacttagtataaacaactcctctagaaagtttggtcatttactggctcttcaggttgaagtttgcatttagagggtggcatggaataaaaacgaggacctgaggagagggagaaagtgagttggagaagacctgttatgcctctgtcactcatttgttctctcacctcttccatgggactccctgggagcacatgttgtgccctacaaggtgtttcatgcctctggagtaatgggaaagaactgcttccagatatcaaaatgtttgatgtctgtttccctttcgttggtttagaaactggttgtttctattttctgtctcatcatttacaaattacggatattgattatggtctgtttcttgccatctcttcaccatattttggtgctttgccaattgctgtgataatggaggctgggcccttgaaactctggccatgcaaagaaagatagtagacagtgccctccctgctggaggactttagagttaaatttattgctttatttggtacataatgtcttttgcataccaaaatgatctaattttagttgtccaaaaaatagaaaatcttttctagccctaatctgcaaagcctatttttagctcaaattaaatagtagaaatgtgtttatgctctatgaggcaacatttagtattttcttggaaattgtaatggttgaatggtatgatgaagcatgtattaaagcatgtgtaccatgttttctgctgaaatgttgctacttgttcttatggattgggtttacatagtgttgtaggcagggagacaaagtgagtaggagagttaagggagaaggatgataaattgcatagtctcctttgtcataataagttaaatataaatgaggttatgactatttcagttttaacaagttctaatactattaagggtgttgtgggtgtttcagttgttgtagagctttaaggagctaccagatgggggagttggggtgtaggaaaaagacttcccacagtagtttagagaacaaatagaaatgagagctctaggttaattcatttactgaggagttatagcatataaagatttgcaggtttaggaagcatcagttatttgctaagtattgctcaaagtatagttttatactgcccttgctaagtgcatttcctctcaaaatagtcaggaagtgcatagttctgaaaagatattcattgatgttttctctgttttaaaggtctctctctgtcagagtgttgctttatcttctctaaaaatgtaacacatttaagtcagaatgggagcaatgcttatcatgggattattttattgggagagggctagtaaggaggatagaggaaatgacctttggggcttattcctcacaatattttcttagtatcagggatcctgaaatactgtgaaatcatttataagatgccactgattccacaatctttagctggtatggaactctctgtttttttataagtaatgattttttgcttatatgtcaacttgtatatacttttttgtttcactgtgatttgtaatgtgtatttaggagccttttaattagtcataaaattgtgaagaattagcttaaggttaggttaagactaacttggagattttctgggaataactctaaataatataattgtttagtagataagaatatgtttaacatatttgttatcttggagaactagttagtgtagtaacaacttaccatatttattggtgagttaagattaatagcaataaataacttctgccattatagttcttgttactataacttggtaactgatcaatttcctctttcattaaaagtaaatattttcagtattttactagaatgaattggaattaaggcggttgaaggggaaataacttaataatgttactataatgtagtgatttagagcaagactggagccagactacttgggttgaaaatgcatctcagctacttactagctgcacgaactggaatgatttacttcatctttccttacctcatatttcttatttgcaaaatggagataatataattgcacacttcctagagttgccaagacgattaaatgagttaatttatatcaagtacatacttagaacagcatggtatataacaaacaaatggaacatgaatgtttgcttttattattattgagtattccccaaataatgtttgcatcagatgcagaaggtttgcttacttttttaggtgagaaaactgatactttgcaaggttaactaacttgttgatatctttggtcagagttaacaagccacagaggcagaatttaaattcatttcagtctgattccaaacctcatgttcttctcattactttgtgctgccttccagagttgttgactgtgtcatcactcctctgatgctaattacacaccacctttccagttctctgaattcttagaatcgtcatgatgtcacattttgcttagtgctttgctctttcaaatgtacttgggatacttgcttgtatgagacaaacttcttgtcagtattgaggaaagttcagttgtgttgcaatttggatcatttcagtttagaaactaggattgttctttagattttaggtgttgaaaatgctaactaagggtgatggtgtttcccatcacaacacaaacgtggtttcatagctatgctatagtaaacactgtgacagtttttttgctcatatttcaagctgatcttgctacgtagctggcctcatgtgttagacatcattaggccagcacaaaacctgcaaaaaggctgtgtttctgatgttgttgatttcttttaatggaaaagtttaagaatatcatcatataatcttattaaacaattcctaaacagagactttaggtagtggctctgtgtaaattagagacaacttctgtattctgctctctgcttacatactttccctgagatagttagatacagtagatagtcctgagaaagaatgagaccattgtatatggacactgcttcctatatgtaaaggataaacactataatacaaacatatccttaagttatacaagtcagttttataagttacaaggatattgagtatgtagccttttcgctggcttcttttgtttagaagtgtgaatttaagactaatccatgtctttcacagagagctcattcctttcccacaactgccctgaaaaatattccatttaacatgtaccacagtttgcttatccattcattgattgaaggataccttgattctttccatttttggttattggatattgagtggaatgtggcatagtttccctcttctcctagatattttttctcttttaggaacatcttcttctgaatcttgtgacagactatttcccatttgtcctgctaaatttctccagacatagcttttcttttttgctggaagaacatggcagtcctttttcttaattttaaatttgtgtttctgtgtctctaaagcattgtttcgctatcactagcagctttctgtctagcacctcttctttgtgtgaagggagaacaacccttcagattcctaaattcttcaggttgtcttttgttctcttttctgaactcttcagtaggttggtgtttatttttcgtttccctttaagttttttttaaatgaagttttaatgtagttttaggtttataaaaaagctgtgaagatagcacagaaagttatgatatatcccacacccattttccccatttgacatcatacattaatatggtactttggtcccaatttataaaacaatattgataggttattattaacaaaattccatgctttatttcaatatccttagtttttaaccttttcctgttccaggatttcatttcacattacatttagttgacttatctccatagcttctcttatctatgacaatttctcagacttatgttgtttttgatgaccttgacagttttcaagtgtactggtcagatcttttgtttgtttcctgtttgctttggtatgtggcaatatgcccatcattggcctgacatatgcccatattgtgtgtgtctgtgtgttcatagtgtgttttgagcacttccttacttcccagcactataagatgttccagactcatctttcatactttctgccccagttgtctagaatgagccatttctctcaggagccctgataccttttattggagaatggtattggaaaccatgacctgggcattggttgtactcattgctattggggtgttttgcttctacgccctctcagctgacagagcaagagaatatatgtgtgtagactaactcatatatatatgcccatctataaacatttttatatgtattcatcatatgctaaatatgagttaatactgatgtctccaactttactccattaccatatggatcattctaacctttccctcttgcttgtctatatccttctttctaacaaggagaaacctgactccctttagccatccatttactgaattcttcaattccagtgtacgtttatagttgtttcagaattgttaacagaaactcccaggggaaacaattttatcaactaaaatacagtgcctatgggcagtttgggagtatgtagttatgtataaagctttatagtgtccactcatatccagggttacttaggtaagcacctttctaccccaccacttccagtaagatttttttcatatatttgtaatacagctagattcttttattatagtcttccatcctgtgatactttgacctcctaaacacacacacacacacacacacacatttaaatttgtatacagtaagtttagctcttctgctgtaaagttctatgggtattgaaaaatgcataatgtcatataactgccattataacatcataccaaatacttgcactcttctaaaaaaaatcccgtgtttcacttgttcaaccgcatgtcacctccaaatccctggcaagtaccgatctgtttgccatgctatagttttgccttcaccagagtgtcatataaatgtaatcatatagtatatagccttttcactggctccttttgtttagaaatgtgaatttaagattaatccatgtctttggcagagagctcattcctttccccccacccccctgaaaaatattccatttaacatgtaccacagtttgcttatccattcattaattgaaggataccttggttccttacatgtttggttattatgaattaactgctataaaacattcacttgcaagtttttatgtagactacattttcaaatcagttaggtaaatacttaggagtgcaattgttggactatgtttaaccttgtaagaaactgtcaaagtgtcttacaaagtggctgagccatttgcctttccaaaagcaatgaatgagacttcctattgctcttcatcctttccagaaattggtattttccattttttagattttagccattctaatacatgtgccttcctccttgaagttttaataaacaaaagcagcacctgttatctctttataatttctgcatataccaattataattaagaattttgttttctggttttgtcattctaaatacttttcctgatattatgactgaatttagaaactgcttaaaaatttattagtgatagcaatgattgcccatgatactactgtaataggtagactctttctcttttgcttagtaacaataagttcctggaatgaagttattcagcatttattcactgggaaatgaaatattttaggaatttcagtgtaactttgaggtgatataaccaacagggtcccatttgttgaaggtgttgaaatataagatgtccacaaatggtctttgttaatatcgttatgctctcctaacccccagcttgcctgagttaagattcctttcaacactatcaacagccagtgagtcaaactcacttaactaaagctcctttactcaatacattctcataacaaaattctcaaatttcttagaaactcttctatttttgttttctcaaagatagtattactgccatttaaaatctgcaaaactccttagttggataaaacaaaacagaacaaaacaaaaacacttagctctgacttggagcagaagaaatggaagcacagctaggtcaggctgcttgcatggggtcacaccattagcctctggggagggcagtgtttgaactatgaggctgtgatggtagagcctgctacattacttattgacccctcaactgcttctgttaccaaacagtaattgttattattgctttttctctgagttagaaggaagattattcttcccttactatgtgagaaacatgattgtgggcctgtaatcacttcatatgtcaaactcatagcttattttgttgccatctcatggagcagatttatagtgacttgtcacatttgctttttgaaatactgtttttttttgtctttatttctttgaatcttttagctcaagtgagcataccaccttcctttctcccccaacccttttcttttgtgttagaagacttttgttaagtaaatgaattatttcccattcatgaggctgatgtttttgtccattgtgttatctctctgctttcattgttctttgatgcataactctgactcaactacaaattttaatagcattctgtttaattcttctgacagttagtgaaaatttaagtaagattagagttaaattcaaacatcctgggttctatgctagatgagttgttgttcttactagtcttgagttcggttcttcagtcaattttaagtacttttgacagcatttctattgtaatttatttaaattaatctgatgagtagagttttatgtgtcacaataaagatgttacttaaattaagacattttatatatggtaaattccccttatgatcccactgttagtcccatttttcaaaagcaaaaatattaatctcttattttctttgagtctgctcagttaaagatttccatatgttaaattttccatcagggtagctatggactcttatgtatcatgggtgatttttataggtgttttggagtgctcttttcccatttctgttactcatagtagtacctaaagtgacatcttttcaaatctaataagtttgagaccaaacttccaattcctggtctgttgtggttttttcctatatttccacaaagtctgatcttaaccttgagaaatggtaagttttctagtatgaagaaagaagttgtagataggatcaggttgggtagagagattgttgggtggtagggaatggtatgggatgtgaggactaggcttcatttcccaggtagaaaagggcagttagaagaaccagtgtaggtccccacagaagacatgactcattgatggaatggagggagaacctccagtgttggtaacaggcatgaaaataaactggtagagcatatatagaagtcaactaaacaagaaacgcatgtgattttcataagcaaggatactgaagtaattcctgactcctacataatggtcaggattgaacattgtccagagccagataagtaaaagaggaaaaaccaactctgaaaatatcaattttaattttgatatttatacatttatgcttttattcttcctagggaaatatgattgcattattgatttgaatcctaatcccaaaaatgcttatgtctatgctagactctagatcagtggaccttacattccacaagtgattgtacagtaggatcatcgagagacattaagaaataaaagaggcctatagacatgatacccagatattttgattaatcatatctagggcagagaccagaactttgtattttaaaaatacattctctagataattttagtatgcacccatgacttttaacaatttaactccaaggctaatcctgctcttgggcaaggatgcttaagaaactgtagtcaattcttaggatatttgataccaagtcacctctactgttagttggtactttaaaatcctgtgtttctttctgtcttatttctgaaagtgggttgttgccttgtactccactcaattcttttgacttattcctacttctcttcaggactttagttctatttctgaatcccacacaggaactggtgctctgctttcattcattgctttttgtcttccagatacatgcttaatgtctcttgctagatgctctgtatttatcttttgctagatgttctgtatttatccctccctccctcccttcctgcttccctccctccttgcttccttccctccctccctccctccctcctttcctcccttcattccttccttccttcctgcctcccttttgccttttctgtatctctttgccaaatctccttcatgctgataactgctggcttagattactggcttagactgccatcatttgcatcacccaattagaatatcatatttttttctgattttctcctgtttatgtataagtgggcatacctagttctagataaatccctccctttattcatcccatgtcattaattccacaatgacatgcaatagggttttgttcaaactaatgtcagaaatagtgggtcatgcattgttttcataaaatgcctggttactgctagatttttttacttgagagctttagataacactttcctgtccactattactattgttaggatcagaaatcctattaattccgagaggacagtgttaccctagggagaaaataaagtgggcaatagaatttgttgctgcaataggaaagggaagtttatacttgtctgtgagctttcataaagcagagtcattttaggatctttgcgaagaagatatcaagggatttcagccagagaacaagcagaacagtgacaaatgatcctgactcttgtgagttactccactgagcgattagtgcccaggaaaacgttgactgaaaatacccaattgccataatttttctgcttttcattctctgtcttctggttctgtgtacttccccacaccattttatgagacttcattcacctcttcattcacttctagtacctcagactgtttttcattaacctcttttttttggtttgtttctataacctttctattttcattattcttattctcaatcttacattttaataaaaagcaacaattcaaatctgccaaacgtgtttacttctcttaatttgtcagtacatttttgctttagtgctatttttaagcttaatattccagttgccaaatttagtagtcaagcaactctaacttactgcaaatttatacaatttctttaattcagagctctaaatgatcactagggtttcagctggactagtatattgttatattaactgcaggaaaagattgattaatccacagacgtctgtatataatattgtggaggaaatatttgccctattaaaggaatagtttttaagtactttgttccatcaatacaaatatttattgaatattttgtatttttgggtactgttctaggtactggtgatcatcagggagaaaacagcaagtgggcagccaggcagtaaaaaactacagacaagtaacaaatacgaaaacttcagagtgatgcatgctgtgaagaaaaataagacaatggggccgggcgcggtggctcattcctgtaatcccagcactttgggaggccaaggtgggtggatcacctgaggtcaggagttcgagtccagcctggccaacatggtgataaccccatctctactaaaaatataaaaactagccaggcctggtatgggcacctgtaatcccagctactcaggaggctgaggcaggagaattgcttgaacccaggaggcagaggttgtagtgagccgacatggtgccactgcactccagccttggcaacagagtgagactctgtctcaaaaaaacaaaaaagaaaagagaagaaaaataagccagtggaatgtaaaagagtgtgaagggcttaaataatatgttaacgataatattcttaaatccatttaagcaactcataggatttctatatgactgtagtatttgtgctgtttcactgatatttctggatttagagctccagaaatgaacttttttttttttttaaccttcactttaatatggaggaggttgaggttaatgaaagttctggtttctccactgatgtctgagtagcatttgctactctggatttatttaagatgaatgaaaggagacagtgaggctgtagcattgtattttgggctagacaaagtcccgagtggtgttcatcatcccaccagtgtgttttgaatacctccatgtgccaggcctgtgctggccatgaagatttgagagtgagtaaggctgatgtcgtctctgctgtcctggctctgtcagcatagaagctaatgggaaggccacatggcaggaggtataaaacttttctactcagtggacagaatgcaaagctgcttgagtgtgaccactagaagagagccatcccaagagaagtggaagtaaaatccacaaatcaaatgcatacttaagctttctcttgctgttgttttctttttctccatatacacacacatacacatatatgcctatatacataagtacatacatacacatacatgtatacatatgtatgtatacacatgtataaattatatatgctttactatttgtaaggatttttcatgtatactattttgtaccttgctaaagtctataattaggtattattatttccattttacagatgaaggaattagacccagagtgtaagtactttactccaaatcgcttagccaacaaatgcttgcagctatatttgaatatagttttttaaactacaggaaaggagtaccgctctttttaccatgttgcatttttctctgtttccaaaaataagtggtaattgtgacacatcttccattaaaagaaccacctctgtttcctaaaaaaaaaacaacaccctgtgtttatgtattagtatatactgctacatggtactgtatgttattttggccaactccctgaattaaaaaatatatatttttctttttttgagatggagtcttgctctgtcgcccaggctacagtgcagtggtgcaatctcggctcactgcaagctctgcctcccgggttcatgccattctcctacctcagcctcccgagtagctgggactacaggtgcccgccaccacgcccagctaattttttcgtatttttagtagagatggggtttcaccgcgttagccaggatggtctcgatctcctgacctcatgatccgcccgccttggcctcccaaagtgctgggattacaggcatgaggcacctcacctggccaaaaatattttataaataccttttgccaatgattattctgtgtctgtgctgccagagtgagcactgacaatatttattctgggtatgaaagtatttttctgactccaaatgagagatagaaaaacagatctagagagcaagggttttgagctgataaaaataggaggaacccagcttatacttctattaatgcacacttcatgatgtgcttcctaattgtttacatgtctttctctttgacttgaatgtaggtacctagtggtcaggtacctacatttaactctttggggcctatttaactctttgtaaccacagcaggaaggccagaggccctggaggggtagctatccaaggattattgtttgaaagacaaataaagactgaggagtattcttgaagaaaggaaactaaagacacaagaaaaacaaatgcaaagcatgatcctgtactggatctcggactaggaaataatacaactataaggtatatcattgggacaatgagcaaaatttgaatatagattgtgggttagaagatagtattgtgtcaaagtgtacatttttatacaaggaagtattagggatgaaggggcataatgtctgctacctactctcaaatgatgtgtgggtgtgtgtgtgtgtatacgtgtgtatgtgtgtgtgtagcaaaagagaagggggaatgagagagaataagaaagcaaatggcacaaattgttcacaaatggtgaaacgagatgaatatgagaatttttatactattcttgcaacttttctctaagtttaaacttatatcaaaataaacatttccaaaaatgattgaataaagttaaaatatattataagtccaaaggaactttgtttttattgggttgtatccccaattaaaaacaaacggacatcaccacaaaactaactaaaataacaaacataagtgagtttaagagtttgcagcgtatttttatgctgctataaattcctagtatcacctatgaatgcatcaaattctatataattagtgtccagattggagtctatctgtggagtttattttccttaagttttgttttctgtctcccttataacgtgatttggtgatatggagattaaggatgaaattggaatagtgtctgaacgtagtcccactctgtttatctcctattgcagggcaattgataccagaataggtgattggttcctgtatgttccagaacatttcatttctttcttctacacagaaaaatattgctcaagaataaaatcacattttcaaagaataaaagtaaaaataaaactgctgactacttctattgcttaaggtaccgattttcatggtactatattgagtgacatctatacacggacatgtagctttcttcttgtcatccctttactattatgataattttggacttcccaaatactttccttgaattcagaagcctcatcaatcattgacatattctcctctgtagactctgatttttttattgcttccctgacattttaaatagccagtatgcatcatttttcatggcctgtcatcagtcattagataatattgcaatgtgctatcaaagtatttctatatttagtagcagtacattctgtatctccatatagcattgtgtagaattagttacacaggatcttcacttaaagcaggacatcacactaagttggtgtttagtgtttactgaactaataggcgtgtaaagtcaactgtttagaagataatatagctgtacatggtcaaaattattaccactgcctatatttttaaattaataacaggtcagagcataagcacatgatggatattcatttccctttttgttggaatagacaaaagatcagtttcaaaaatggtgttcatttcagattatacatatatgtgtatatatattttatatatatatataaatatatataattccttaaaactttaattgttgcataaaaatactgaggcttatgtaaattattctcacatttcaaatttatttgaaattaaaaattttaagcaaacatatgcaggacataatcaggtattctgtctatgtgatttaactccccccacctactcccacaattcctgcacacactcatatacagactttcatttctagtttttttttttttttgagatggagtcttgctctgttgcccaggctggagtgctgtggcatgatctcagctcactgcaacctctgcctcccgggtttaagcgattctcctgcctcagcctcccaagtaggtgggactacaggcacatgctaccacaaaaatatttgtattttttttttttttaagtggagatggggtttcaccatgttagccaggatggtctcgatctcctgacctcatgatccacctgccttggcctcccaaagtgctgggattacaggcgtgagccaccacacccagccccatatacacattttcatgctgtcatggacctcatagtcctgatcctttgggaacaaaattttcaactaaataatagaatgaatctagtcctgttaataggaggcaaaaattcaagtaacagtggtattcactgaccattgttcctgctctcaccttagtataaatgttgggaaaataggagggatttgtgggatggagtaaatcttggtatctccacataggaactttattggacttaactttattcttatttgtctaagtctttgtttggatagttctgagtagtgaaacagggatgttagtagtcagctctacagacagcagaattgaagtctatagtccagttgtttaaaatgaagattgcctacattgggagatttctacttagaacaaggttaccatagtcacaaggctgaaaaatttctcaaatatctatttgacttctagggcaccaagccaactgattcactgttagtgggatagaaaaaaaacaaactatgtagacctttgacattcttctgcaagctagaaaggaaatagcaataatatactggcaaggctaggaatgtgctgagaagagaaaagtcagcttgcttctttaattgtgactcttttttgaagcacacttaagaagcattttgaaaggaatgtggcatctttcatcatgtgtgaattcaagatcttatagctttgtaatatctttttcctgccaagtactagattcggttgaccttttggataatgcatttttgtttgctttcaaatattgagaaagatctttcatataaccttctgttttccttaggaattaaatagtgttgagggaatcttaaaagtttatgggaaaaaataaaagatccacattcagacatctttgttttatatctcttttagctcagacagccctaagtctacctattaagctatttataagaataaactaagtctctggtgctgttttcttcctgcttctgcttgtgtttttaacattcctatgtcacatatttttcttgccttcgttctctaagaagtggagtgcctttgtttgtttatgactctgcagtgggggctgctctcctttgggcatttcaggagggtgagtggcaggacacaagttggaatgagcaaggtgtgctcacaatgcattgaagagactagtctaatctgagatgtgattcttgttggtgcattataaaaaatgagcacagggaatggttcttatgctgtgtctgcaggatatgccagtgcatctcactagataaattttgttccacttagcatccttccttcctcactgttccccaaatttaaaggtttggattttcactaatatcgtctaatctctggcactcctttccatgaaattgtggtatgtgtcctggtgagataattagaaaattggtctgttgttatctagttgacttggtgcttgtgttggctgttactttgttcttccttaactcttctttttagtcccttctgtgctagcttctgtagaaaagaggatttaacatactcacgtgcactaccgctgttaccaccatcatttttgctttggaatggtgatgatttaagaacttaaaaccaaaggcttaccagtatccagtccgtattttctacattatctacatttccccattaatgagccctcttgaatttaaattaaaatgtaaaggaacctgaatatgcatttattcattcaaatatctattcaacaaatatttattgctctctagatgctggcattgtgtaggtactgatttactcagccaagtacagtagagtgctgcacaaattaatagcagactactctgttctccttttattttgggcttctcaggcatcctgtgctgagtcttggatcaaaaacacaacaatacagaaaataatctgttctaattccttagtgttcctggtaatatatcttacacttggacttatggcttatagtactatataaattcttaagaacaatagactgaaatccttcatatctttatcttagtaattgcccatacctgagatttaaaaaaaaaattcaaaacaagaaaaaacatgaaataacagcttagtgctgtttattgaatgctcctataaaaagacaaaatattggcaacaaccaacagtccaactataaggaaagagtcagttaaaatatgatagctctgcttagaagaattttaagcagccacttaaatgagaactatgtggaaagattatgctacagcatgggaaaatgtttgcgatgttgctgtagctctagttccccaggaaacagactccaacatggagatttgcactcagacaggctcctgggcagtgtgctcaggatcagtgatcccaccaggcaaacttcattaggtttcaaggcctgagaatgatcctttgtggttctcagctctgccttttgggtcattctcatgaaaggtagtaagtacatgtttgcagctgaggagttttaccagactgtttccctgtgagaatgtaaagaaagtagatggggcagagggaaaaattgaattgctcttgcagaagccatcacaacagaggtctcagctgatctcttcagaattgcccctgactggggcaagaaggaggtatctttttgttatgactccccactttccaaatgaactatctttgaaagcagcttcccttgcggaggcaggtggatcttgagccggcagctctcttcagctgaaggcaatgcctagagtcagactcagttgagagctgacagctacaaacactcccagtatctgttagagatgacagattatacaaaaaagaaaactttatacataaagtgtttgggcatatcatgaacattatgaatccgagtacataaaatatgtgtgagtatgcacaaaaactggaggggacactgaaaaaatgaatatggctctgttacaaaagaaaagagaagccatgagagcataatcctttcaccaaataaacaatgaaaccaaacagatgatagtttcctctaaaataatgaaagaattcatgtatatattttcccctcctcactcaattttaaaagatgaccattaaaaaaattctttcaggtctcagcctttcccttgtgttttatttgtggaatatgttagagtgggataatgacataatgacaaacatagctcagtgttctgtgagatctactttgagaccgtaacgaatatgaatagttgctccgcttggcatgcttttaatctttcctagggttgcctcacccacgatgctaaagaagcagtgcttatgagttcagtaagtacatgcaccactgatactcattttcacggctctacatttcttcctttttcagcttaacattttatatattcatgatcaaaatggaattgggcatgaaaaatgtgaacggcacaaggcaaataaatacaatactagaaaaacagtttgaggtgtatatgctagtgaagaagaataaacctgaacatctattttcccaggttagagcacatatacacaaaagactgtaatcctggcataaaagtttctcatgttagctccccttatctgaaatagacttcctatttctcaactgctttcttatttccttccaaagcataactcgtagtatccttccaaatcatacatactgtgtgtgtgtttcctagtgtacccttttttttttttatattaaacagttctttaaagctgcctttaatgcacttggaattacttctttgaaaaatacaagatgagaaaagacaggagaacatgagaactattttcagatactttaaaggacttctgtgagaagaggagatttgttcaaatcaccacctagtatatgagggtatattagaactagtggactaaaattataggaatagattttgccccacatgcaagaaggaaggaattttgtaattactggagatattcagttttggaagagcaagcttcctgagctgctcatcagggtgctgtttaagtagaggaaagatgactgtctatgagatctgctgtgttttgagagagattggactggttatcagtcaagttctcatgtacttgatggcttcatgaatcaatgttatactaaatggtgtattcacaaattctgctttaaacaaatatatacgtaatcataagatttcatcttccagaagtatagaagtattagcattgcttgtgaatgctgtaaaaatgctgtgatgctactgtaatagctacagcatggaaacacaataacatactaatttctgtcactcttaacatctaatgctgtttgtctaatgaaatacattttagacctttggctaagtatttattacctaattcaataggaaaattgaaaaaaattttagatttccatcaatttcatttctttaccacaacaccttttttttctgaaaaaaaaaaaaaaaaaaaaaaaaaaaaaaaaaagtttgtccctttgctcagactggactgcagcatagctcccaacacttggttggagcagttgaggagggtgaatcacaatttagtgatttaaaaaaaaaagtgaccattttttttggaggcggggccaagatggccgactggaagctgcgtgttcagaggctcccactggaaaaaaaatctaagcatgtgaatccttcatcagcaaccaaggtattcaggttctctcgccaaaattgacaagaaggctggcctgaccacagagagaaggaagagcagtgtagtgagaaggcccacctgagagccacacggggaaggggaagccccttccccaagccaaaggaggcggtggtgagtgagtgcgctagggaaactgctttttccacagaaccctgccacccatggattggaagatcccactcgtgaacccacgccaccagggcctagcgtcccagccttggaacatgcagattcttacagcctctcagctggagtctgcttaagcctatggaactcaggaagtgggggttgctggtggggaggggggaagaagaggcaaccagcaccagctgtggctgcctgctgtctaagccatttgagctcctggggggaggggcaagagtcagcactgggacttgcaactgcctaacacactaagctccctgggcagggtgggcacacccatttctatagctccaggctgtactttcccctgctagagctagagccagggaggctggacgacttgctcccaagacttgtccccacagcccaacacaccctctgtggcagtctgcggctagagtgcctcttcaggcctaatcccaacccatcattcctcagtgggcggggcttccctgcaggatctccaataactccagctagaggctcggggacagaattcagatctccctgggcctgagtccctagggagagggatggccacagtctctggggaccagcagacttgctgtctcctcttggtagttctgagaaatccaggcagctcagatgagtgggttttcccctagtgaaacataccctctccaccaaaggacaaagtgcttcattaaatgggtcctgctccctgtgccacccgattgggtgagaccctccaacaggggttgtcagacaccctatacaggagtcatcctactggcatcaggttggtgcctgtcgaggtcagaggtcccagaagaaggagcaggcacccatctttactgctctccagactccttgaatgacatctccaggaactggagcgaatcacatgaatacgacctgaagtgaacccctagcaaactgcagcagtcctacagaagagggaccaattattgaaagaaaaacaagcagaaagtgacaacagcatcaacaacaacaacaacaacaaaaaggcctccacaaaaaaccctatccaaggatcagcaggctcaaagactgaaagtagacaaattgaggaaggtaagaaagaatcaatgaaaaaatgctgtaaacccaaaaggccagagtgcttcatctccaaatgattacaatgtcaagggcacagaactggagggaggatcagatggacggattgacagaagtaggcttcagaagatggataataaaaaactatgatgagctaaaggagcttgttctaacccaatgcaacgaagctaagaaacttgataaaaggaattgctaactagaatacccagtttagagagaaacataaatgacctgatggagctgaaaaacacagcatgagaacttcacgaagcatacacaagtatcaacagccaaattgaccaagcagaagaaaggctatcagagtttgaaaactaccttactgaaataagacatgcagacaagaatagagaaaaaagaatgatcaaagtcttcaagaagtatgggacttgataaaaggacagaatctgcgattgattggagtaccagaaggagatggagagaatggaaacaagctggaaaacacacttcagaatattatccaggagaacttccccaacctagcaagacaggccaacatgaaaattcaggaaatacagagaacatcattaagatactctgtaagaagatcaaccccaagacacataattatcagtttctccaaggtcaaaaaaaggaaaaactgttaaaggtagccagagagaaaggccaggtcacctacaaagggaagtccatcagactaacagtggacctctcagcagaaactctacaagccagaaaagattgggggccaatatttaatatcttaaataattttcaacccagaatttcacatctagccaaactgagcttcataagcaaaggagaaatgaaatcatttccagacaagcaaatgctgagggatttcattaccaccagtcctgccctgcaagagctcctaaaagaagcactaaatatggaaaggaaaaaccagtaccaggtactgcaaaaacacagcaaaatataaagaccaatgacaccatgaagaaactgcatcaactattatgcaaaataaccaaatagcatcatgttgacagaatcaaattcacacataacaatactaatgtaaatgggctaaatgccccacttaaaagacagactgggccgggcatggtggctaacacctgtaatcccaacactttgggaggctgagatgggtggatcacctgaggttgggagttcaagaccagcctgaccaacaaggagaaaccccatctctactaaaaatacaaaattagttgggcatggtggcacatgcctgtaatcccagctacttgagaggctgaggtaggagaattgcttgaacctgggaggttgcggtgagccgagatcatgccattgcactccagcctgggcaacaagagcaaaactctgtctcaaaaaaaagaaaaaaaaaagacacagactggcaaattgaataaggagtcaagacccatctgtgtgctgtattcaggagacccatcttaaatgcaaagacacacacagcctcaaaataaagggatggaggaaaatttaccaagcaaatggaaagaaaaaaacaagaaagcaggggttgcaatcctagtccctgacaaaacagactttaaacaaacaaaaatacaaaaagacaagggtattatacaatggtaaggggaagaattcaacaagaagagctaactattctaaatatatatgtacccaatacagaaacacccagattcataaaactagttcttagagacctgcaaagagacttaaactcccacacaataatagtgggagactttaacaccccactctcagtattagatcaatgagagaaaaaattaaaaaggatatttaggagttgaactcagctctggatcacgtggacctagtagacatttacggaactctctaccctagatcaacagaatatacgtccttctcctgtgccacatggcacttaccctgaaattgaacacatattttgaaataaaatactcctcagcaaatgcaaaagaactgaaatcgtaacagtttcttggaccacagtgcaatcaaattagaactcaggattaagaaactcactcaaaacgacacaatttcatggaaattgaacaacttgttcctgaatgactcccgggtaaataatgaaattaaagcagaaatcaaaaagttttttgaaaccaatgacaaagagacaacataccagaatctctggaacatagctaaaacagtgttaagatggaaatctatagcattaaatgcccacatcagaaagctagaaagatctcaaattgacaccctaacatcacaattaaaagagttagagaggcaagaacaaactaatccaaaaggtagcagaagacaagagataactaagatcagagaagaattgaaggagatagagacatgaaaaacctccaaaaatcaatgaatccaggagctgattttttgaaaaaattaacaaaatagatagaccaatagctagactaataagagagagaagaatcaagtagacacaataaaaaatgataaatgggatatcaccactgaccccacagaaatacaaactaccatcagagaatactataaacacctttacgcaaataaactagaaaatctagaagaaatggataaattcctggacacatacaccctaccaagactaaaccaggaagaagttgaatccctgaatagaccaataacaagctctaaaattgaggcagtaattaatagcctaccaaccaaaaaaaaaagcaaggaccagatggattcacagctgaattctaccagaaatataaagaggagctagtaccattctttctaaaactattctaaacaattgaaaaggagggagtcttccctaactcattttatgaagccagcatcatcctgataccaaaattaggaagagacacacaaaaaagaaaacttcaggccaatatccctgatgaacatcgatgcaaaaatcttcaataaaatactggcaaactgaatgagcagcacatcaaaaaacttatccaccatgagcaagtgggcttcatccttgggatgcaaggctggttcaacatatgcaaatgcataaacataatccgtcagataaacagaaccaaagacaaaaagcacatgattatctcaacagattcagaaaaggcctttgataaaattgaacatcgcttcatgttaactctcaataaactaggtattgatggaacatatctcaaaataagagctatttatgacaaacccacagccaatatcatatggaatgggcaaaagctagaagcattcctttaaaaactggtacaagacaaggatgccctctctcaccactcctattcaacatagtattagaagttctggccagggcaatcaggcaagagaaagaaataaagggtattcaaacaagaagagaggaagtcaagttgtctctgtttgcagatgacatgattttatatttagaaaaccctggctgggtgcggtgactcatacctgtaatcccagcactttgggaggctgagataggcagatcacctgaggtcaggagttcgagaccagactggccaacatggtgaaaccctgactctactaaaaatacaaaaattagccaggtgtggtagtgcacacctgtagtcccagatattgggaggctgaggcaggaaaatcacttgaacccaggaggtggaggtttcagtgagctgagagtgtaccagcctgggcaatagatcaagactctgtttaaaaagaaaaaaaaaaccctcatcatctcagcccacaaacttcttgaactgataagcaacttcagcaaagtctcaggatgcaaaattagtgtgcaaaaatcacagtcactcctttacaccaataataggcaagcagagagccaaatcatgaatgaactcccattcacaattgctacaaagagaataaaatacctaggaatacaactttcaagggatgtgaagacctcttcaaggagaactacaaaccactgctcaaggaaataagagaagacataaacaaatggaaaaaacattccatcctcgtggataggaagaatcaatatcgtgaaaatagccatactgcccaaagtaatttacagattcaatgctattcacatcaaactaccattgacattcttcacagaattagaaaaaattattttaaatttcatatggaatcaaagaagaccctgtatagtcaagacaatcctaagcaaaaagaacaaagctggagacctcatgctacctgacttcaaagtatactacgaggctacagtaaccaaaatagcatggtactggtaccaaaaccgacatatagaccaatggagcagtacagagacctcagaaataacaccacatatctgcaaccatctgatctttgacaaacctgacaaaaaacaagcaatggagaaaggatctcctatttagtaaatggtactgggaaaactggctagccatatgcagaaaagtaaaactagacccctttcttacaccttatacaaaaattaactcaagatggattgaagacttaaatgtaaaaacccaaaccataaaaactctggaagaaaacctaggcaataccattcaggacattggcatgggcaaagacttcatgacaaaaacaccaaaagcaattgcgacaaaatccaaaattgacaagtggggtctaattaaactaaagagcttctgcacagcaaaataaactatcatcagagtgaacaggcaacctacagaatgggagaaaagttttgaaattttctgacaaagggctaatatccagaatttaccgggaacttaaccatatttccaaaaacaaaaccaaacaaccccatcataaagtgggcaaaggatgtgaacacacacttctcaaaagaagatatttacatagccaacaatcatgaaaaaaagctcaacatcactgatcatcagagaaatgcaaatgaaaagcacaatgagataccatctcacgccagtcagaatggtgattattaaaaagtcagggaatagtagatgctggcgaggctgtggagaagtaggaatgcttttgtactgttggtgggaatgtaaattagttcaaccattgtggaagacagtgtggcgattcctcaaggatctagaaccagaaataccatttgacccagcaaccccattactgggtatatacccaaaggagtataaatgattctactataaagacacatgcacatgtatgtttattgcagcactgtttacaataacaaagatatggaaccaacccaaatgtccatcaatgatagactggataaagaaaatgtggtacatatacaccatggaataaaatgcagccataaaaatgagtgagatcatgtcctttgcagggacatggatgaagctggaagccatcgttctcagcaaactaacacaggaacagaaaaccaaacactgcatgttctcactcataagtgggagttgaacattgagaacacatggtcacagagaggggaacaacacacaccatggcctgttggagggtgaggggtgaggtcagggaacttagaggatgggtcaataggtgcagcaaaccaccatggcaagcgcatacctatgtaacaaacctgcacgttctgcacatgtatcccatttttttagaagaaatttaaaaaagtgaccattaaagaggcattggcattgattaacagctctgagtaagccctccgaggatcggtccatgtggaaatcatgctttcctgctgcctcttctgtggccgccaatttgaacagggctagtcatcatcagcaaaagccagaatctatgtacgtcacagtaatcccctcccccaccttcttcaccagcgggtaagagactggtaaaaagtaaaggcgtgagaagtgatgagaatacttatctgcagggagattccaaatcttgggagccactgccctattttcagtgtggcagattgcattccagaataaggggccaggtgtgggcacagagctgaagcaggtgctcctgcagctcctctttgtaattagctcatgtctgctcattctttgactctgcaccttactgctgctgggctgctgctgggctgctgctggctttgtgtcttctctggcaatatgccagggtgctgaagaaggaaggctggggaatgtgatgagccctttgtcacctgccaggttgccagcatctgatagcaggcatagcacagtggcctgagaaggctgcctgattagacatgtgcttccctgaacctgtccccttcttagcactcaacacctgtggctccttgttggcaaaggaacaagaatttgtcaaacaataagcattcacacctattaaattagtcatttggcataacttgcccaagcttgtgataaaaggcctgccagtgaatactgaagggtacaaaatatagcaatggaaaaatcatgtatgcacacatatgaatttctatcactacatatattatgcctggacatatgatcagtcacatccagatgtatttgttttcattaatccattggttttatattcattcttttatagattcaccacagacaaggcacggtaccaaagattagggttactatagtggtcttcatttagtttctctaaaactccatagtttgtctttctggaccttagcatatatgtttcttcagtctggaatggtttccttcctcccctatctatctactcttttttggtggcctagttgacatttcctttttcttcttcaagaggttaagtctggttgagggattggacacattagcagctattgtgtgggaaatattaggctgggggtaatcacaaggtgctttggaagcctaacaagtagagacatctatctcggtctcagagtgtcaaggaaagcattctgaaggaattttggtgtgaagatatgcaaaataagtgaagcagagaactagctaagtggggtaggtaggagaacagaatcctagttaaaaaacaaaataaaacaaaacacagaaccagccatgtacagaagcctgtaaatgagagagagattgttgagcatgttcaggaaactgaaaagtggttcataatggctggtatagaggtgtgaaatgggggactgagagagggaaggatgggctagtaagtaaaagctggactaagccttgctgattttggactttattcagaaggcaacagtcattggagggctttccagagaaacaatatgatgagatgtataattctagactactgatcatggtggcctaaaacaaagtagtggtatttaggatagagagactagcagaatgtcaggggagatgcattatgaacttacacacaacacacacacacaatcgtaattttattaaaataaaaaaatcatattctaaattattttgacagttttagcttagctttatatcatacaaaatcaagcatctttttacatcttttttatatgtttgcttgttttggttaaggcatacataccgtcccctagatcttctaaaatatttattgcttcatcttttgcattgtacgatcttaattgatctggaatttgattttgtttgaggcatgagatgggatttaattttattgttttccagatggctagtgccatttattaagtaaaccattcttttccctttgaattgaaatactgttctgtggtatattaaaacttctcatatacacagatttacttcagcaaaatgacataattttatgcttttttgcaatgtgtttactggttattttattttcatatctcacagtattttctagaacctccaagataatattgaaaacgatgatagcaagcatacttgtcaaatttctgattttagttaaaatgtttttagtattttgctatttagaataagctgcttctggtttttggaaaagatcttttattatatttgaacagtttctttatatcttattttattcaaaatgcttattaagacttgaatctcacacttttcagaatctactgatatgatcatattttgtttacttttatgaatgtaataatttatgctgatatattttccactgctgaactaccgtttcatttctgatataaatcctacttggtcatgatgatttattcttttataaatcgctagattctatctgctactatttttgcaaatattcataagagaaattggtcttagtatactgtatcagcttttgacataaagttatttgggattaataaaaagaattgagtgattttaatttttttctatggccggaaaatattttaaaaactttgcagtcatctagtttttttcctaattgctagccagaactcaggttcttcttgagtcaactttggtcatttatactttgccagatacttacccatttccattccatttacacatttgttcacagcaagttgcatgtttcttttctgatttatctaattcgtcttaatatgtgcctatgtattcttattccaatttagttactttctttcttaatttcagcttttatctattaattcctactccatagtttttttcttaagctcattacagttttcttaatttggaagctctttatttacttatttatttttgttgctgaaaacatttctggcattttccttgagtatagttttgttgtacctcagaattgtgtatgatgcaggctcctttttattgatttctaaaagttataattccaattttgactttccctgtaatccaagagaatgtattgcttaactctcaaatatatatgccaccttttggttatttctgtttattattaaaaatgtgatctgtaaaatctttaaaatattttatggggtttttatgatcaagtatttgagcaatttttgtaattttacatacatataatacatatgtacatatacaaatgttttgagtttgttgcttttgctattttatttttctgactttgcctttttgttagtttttattattaacatttatttaatttctctgattttgctttttagttttgatcttttgatttctcaaaaggacacattaaagtttttcactaaaattttatttttatcaaggttttcttttatcttcattgttctgttgtatataattttaatttctctatgattttgctgatctattcgttacatagcttggtactgagagacatgtattagtgtttcctactataattatagttgtatagatttcttctttcattctttttttttttttgtgagatggagtcttgctttgtcacccaggctggagtgcaatggtgcgatcttggctcactgcaacctctgcctcccaggttcaagcgattctcctgcctcagcctcatgagtagctgggattacaggaacctgccactgcgcccagctaatttttgtattttttagtagagatgggtttcaccatcttggccaggctggtctcgaattcctgacttcattatccacccgcctcggcctcccaaagtgctgggattacaggtgtgagccactgtgcccagcctcttctttcattcttaattttgaaaatatataattttgaaactatataatgctttattgaaatatgatttacataccatgcaatttacctaacaaaagtgtacaattcgatggttgttaatatattcacaaagttttgcaaccatcactacaatcaattttagaacattttcatcactccaaaaagaaaccccatactcattagtaattaattcctaattgtttttgctttatatatttagctacaatgttgcttggtttatgtctcttaggtcttctttgtaaattgtgattttgttttactttgtctctttttattctgtttatcacttctccccttattctaccttgttgatattaatattgcccctccattgctgctttttttcttgcagtttctttgaattctttgcctgttgactcattttcaaccttttattttttaatcaccttttataagtacaattcttgtgagagttttctcatttaatgggatgatttattcatttacatttactttaatccgtgagctatatgattttcttgatttatcatatttcttttacattgtttttgtttctggtcttttgctgttttgatcatgttgacatatacataatatttgaccttgtatttggagagttctactccaatttcccatttcattattgattatcttcctttttctcttagtagaattagacccatgggttttttattattttaaaacaaaatatcaattattttctttctaagattatattattcctatccccccaaatccccttaagaagaaacttttagaataggtttacttttctcctctctaccttctcccctctcctcaccatccaagtcctgtggtttgctgagattgtttagtttcagaatatgaacaaaatttaccttgtggtagtttggtagtttttctatgtatcagtagcttttttgtttgtttgtttgtttgttttttgagatgggtttcgctcttgttgcccaggctggagtgcagtggtgtgatctcagctcactgcaacctccgcctcccaggttcaagcgattctcctgcctcagctttcccaagtagctgggattataggcatgcgccaccatgcccagataattttgtatttttagtagagacagggtttctccatgttggtcaggctggtctcgaactcctgacctcaggtgatctgcccgcctcggcctcccaaagtgctgggattacaggcgtaagccaccgcacccggcctgtatcagtaatttaaaattaatgttcatactacaactgtccaggtaataggtcattatccataatacatgtctaatatgtataaatgtgtggacatttgtatgtatgtacacatttgtatatgatgtatatgtacacatacatcagaaagcatgtgtctatgtgtgtgttgtagggttcattgctcactaatgtgtctacttttccttcttctcttaaccagactcctctacttcttcattctgagtgatttcttgatcgattaatgtgtttttttgttttgttttttttgtttttgttttttttcattttctaaggtgtttcactgagtgatggaatctctgaatctttgccagatactcttctgggtgataaacttttaggtttcagttctctcagtatctcacctgtatttttctctcatcatctagctttcattgttgcagatgaaaagtaaattttttttaattacctgttttctcttgcaacttaaaagatcttctttatctctctctctcttttttttttttcaggaatccaaccagatattcttaggggtgtgtgtgtgtgtctgtgtttcttatcattcctggttgcaatttatgctttttccatctgtagatgtaggattttccatggttcaggggaaattctctctgtaattcatttagttatagtccttcttccattggtttcttttttctcattctacattatagtgtttttagaggttgttcctctaaatatgtttatggaaaatagaaggatcacagaaaaaatactacaagggactatctgctattttataagaaagacacggacatgtgctttgtgatttgaaaggaaggagtaacactgatagttttgtagtgtatgtttatgatactgcacttgttagatgtggttactaggtgaaaaaattcgtttcagagtactcacatgggggttggcttcatcttcattataccacatttctcattgttaaaatttatttctgatgtatgttttaaaacataaattcacagattaaaaaattttattttaaattcaggggtacatgtgcaggtttgttatataggtaaccttgtgtcatgggggtttggtgttcagattatttcgccactcagatattaaacctggtaccgttcagttattttttgtgatcttctttctcctcccaaagatggctccccagtgaatgcttcctgacatttacactcttctacagtaattttcagtacaaggtctcactctgtcactcaggctggagtacagtggtgcagtcacagctcactgcagcctagacttgcttgggctcaggtgattctcccacctcagcctccagagtagctgggactgcgggcctgcaccactatgcctggctctttttttgtatttttagtaaagacagggtttaggcatgttgcccaggctgggaccacctgctttttttttttttttttttttggagacagggtctcactctgttgcccaggctggagtgcagtggtatgatcacgggtcactgctacctcaacatcctgggctccagtgattctcccacctcagcctcccgagtagctgggactacggactacaggcatgtaccaccatgccctgctaatttttgtacttttttctagatatggggtttcaccatgttgggcaggctgggtcttgaacttctggactcaagcaatcagcctgctttggcctcccaaagtgctaggtttacaggcatgacccactgtgcccagcctaacctgtttttttatttaagtctcccttcaaacattgtctctctgaggagaggcagatactgtttttcttctacttccgtgggtactcctgtgtacccctgttgtagcccaaccataatgtaatttactgttttgtaggggcccatgagagaaagtcatgtgtctttttgttttcatatccttagatgtggcacaagtgcaaccttaaaaggttagtaatattcaccaaacaaatacttagatgaatgcttaatttctatgaaacaatgcttattctccaggtgtcaggcattatgccagtgatagatacgcagacataaatagggcaaggtccttgtcctcaagaaatgccatctgaggtggggtgggatagcagatgagagacaacagggccagatcatgaaggaacagatcgtatttcatttacagctaaaggatgccagcatttatgctattcacctttttaaagaggtgaattaacagtagttaaaaattctaacttaacttacccattaataagagcagctttgttataaattttgccacttgaggaaatgtattcttatagacccagatgtcaagctgtcatagaatcttgtgatgtgaggagattagcattgtctatatgtttcaaatgatttactgtaagtagggggtttgcgtcaatcgtaggcggaactttgggagtcagaattgcatcagttgtctgaattgaattactttgtctgtgctttctgaattttgagattaaagtttaaaatcaaagtcttggctattgacttgtatatttgtaaaagttgaagtaatcttttcttagttttaatattttcaaatctaataacttttttcttttctgatcttgtgcagtttaacagttctgggaataaaaatctttattagttaattgaatattatgggtttatatagaattgccattcataatattttaatgtaatattcaaaaaaattcatttttttttagtaatacaaccgtcactttagcatctggtattccttagcatcatcatttgaaaattaacaatattgtaccttaaagtacagaggtcctttataaagcagcaggctttctagttgatagattgctgcgcatagagtagtttttagtttgttgcctatggtgaacttcttattttctggatgattctttgggatcctggcattaggcacagaacataagcttacactgtattgtctttacatttgtgtgcaccataactgtgaggaccttttcaatgttatgaaaaatgcaagttagaagaacttctctttttctcttcaatgcacatggacctgaagtcttttgaaaatacagttcttcaaagtttagaagcaatccatggaatattttcagtgacacacggaatattgtagttcagcatatatggtcagtttataggaatttttatttattctgtatttagtttttaataagaatttcataactggaagatttcatagcaacaaaggactgtcattgaatgtgtatataaatttaacttgtatcttagagttttctagttataacatagtgatggtgatgtaaggatttggcatagaaagaagttttagtgaaggaagtgagaattaatgttcatgcagagtaatcaaaccaggagagtatggtttgataagccaaaagagatgagagttttaggaggaagggatgattaatagtgtcaaattaaaggaaaaacagcaaacaaggttaagtaagataaggacaaaacagtatgtattgatttaagtatttatgaaagcagtttcaacagagcagttggaacaggagactaatggcagtgaatattgtctgtctttgttttctcttctacactagagaactggacagataagtactattattgtctattctggctgacattattgttagtgaatgcaacacatgttgaagagcagtcttgtaacctggcaatgtgacatgagtggtgatatttttatcttaataagtgactttctcaacaagtcttgagcatccaatccatgaaaccaaaatgaatatgaaatgcttattaataaagggactgtttctcacttaggttttctactcattttcctatcacattgattttaagaagttctttgtcaaactgacttcttggctaccagaagttttagactctatagtaagctcttaaagaatattagatgtgctttgactattttaaaaacaatattattcactctgttcatttgcctcacttctggctgggaggaacactcagggaatgataaaggtaggaaagcagctaagctgtagacagcctagattgctctgcactctaatggggcgctagcaaagtgaccttcttttcccagtcctgcctgatttgcaggacttcaaatgagatgatggaaatggggcaagaaaatatgaatatgtaaactacatgtattgatttcaaccaatgtcaaaggagaagcaatagagtttaggtagaagctgtctttaatatgcaggccaaaatcttttgtatgtgttatagtcctctttggcacataaattccctcatttttcctcatatcatcctcaagggggggatcttgtgatcacatgtgatcctgcttcttattacgatagaatacattgtgcacacttatttatttttcattgtaatatccagcactataaggtggaactcttttgccagggcatcagggagtgattatatatggagaaaacttaacaataacctttaattctgtctcatcagattcctcctccatgcttggctgcccttacttttgtgggtgaaagaatgtaaatcattccagagttctgtcattattattttcttgttttttctccttttccctgaggtctagctgacctgcatgtctttccctgagattgctaatgtaagccttttgtttccaccagatagcttgatgcctatccccattcatgtgccatagatttcttttctggtttatattttccacttaatacatgcatttcgataagaagtaagatgataatatggatgtaatatggacataatatgtaggcaacttggatattctgtgaagaatggggaaatcattaagaaaaagaaaaatatattatttatgataactactgcaaggctattgaaaggtgaacagctagattagcaacatttaaaaagctgatgctctgggagttagggagaaggaagggataaacaggatttttagggcagtgaaaatgctctaagtgatatgataagtgtatacatatcattatacatttgtttaagcccacagaatatacaatattaagagtgagccttaatgtaaaccatggaatttggatgataataatgcatcatgtaggttcatggattgtaataaatgtaccactctggtgggagatatgataatggggcaggctgtgcatgtgtcggggcagagagatatgggaaataactgtgccttctgctcaattttgctgtgactctaaaactggtctaaaaatatgtagtctatttaaaaacaaacaaaaaggttcatgttcattaacattttagaggcatcctgaagatgaactgaaatttatattttctgattcaagatgagtgaattaacctatgtggaaatttgtggatctaagagaaataacctttgttactttattcagtagttactcttttgataagcacttaaaaagctataaattcaattatttatattagacttcactaacatttgcttcccatttacctctaggtttgaagtttgaggaaattcaaaaaagatttggtgaagagttctttaatatatgctttcatgagaatgagagagtccttcgagctgtaggtggcactttgcaggacttttttaacggctttgatgctttgttggaacacattagaacttcttttggaaaacaggccactctggagtcaccatctttcctatgcaaagagctccctgaaggtactctcatgctccactacttccaccctcaccatattgtggggtttgcaatgctggggatgattaaggctgcaggaaagaagatctatcggctggatgtggaagtggaacaggttgcaaatgagaagctatgctctgatgtttcaaacccaggcaattgtagctgtcttactttccttatcaaagaatgtgaaaatactaatatcatgaagaaccttccacagggaacctcccaagttcctgcggacctcagaattagcatcaacaccttctgtagagccttccctttccacttgatgtttgatcccagcatgtcagtccttcagttgggggaaggtctaaggaagcagcttcgatgtgacactcacaaagtgctcaagtttgaggactgcttcgagattgtatctccaaaggttaatgccacctttgaaagggtcctgctgcgactgtctaccccgtttgtgattagaaccaagcctgaggcttctggctctgaaaataaagacaaggtaagtgctatggacttgagatggtgatgggaactagaagagtggataattatttcagtaaattacatggtggctgtacttgtaattatttaggcaagagagcttaaagtgccatttagaagattactggtccctggatgtatgtaaaaagatttggcctcattcccagccattttgcatagtgtctgcctcctccattaatttatttcagcatataaaaagaagacatttattaatactagctatagcaattacaaaaatgatagaactcactaaaaacctgataatataaacacatgaatatttccactgaatgtagtcaaactatgagaaatatagcatttcaatattgtggggcgtgactgcaatatctttaaatacatatgctaaaagttaccttcactttgaatatgttcttttctaaatttcataatctgggaacatctggtttacatcctatttttgtcttaatatgcagaataatgtattccccaaaagctgagaattgactatctcgagacttctgtttaaattttagtattaaaatagagattcattgctttagaacatgatctctagttgagagaataaagtgaagactaggaaattttttgtggatttctttgaatcccctttgggaaatctggattataaattataaataattgatgaaaagacaccagaaataaatcttaaaatatttgggtttaaatgaacattttgtccctcaggtaaaatattttaaaaagtcaacattaaaatagataataaaatgtaaagaaaaataaaccatgattttttatgtttagtaatatgctttcagtgattaaacggaaaaacaacattaatttccaggacagaaatttgtatagttccattcagtttccagtagagtgtcttttcaacattttgtactagggtaaataaagttcttttaggctatttagcctgtttccaagcatttgagggaagctattagctattagaaatgacaggttgctctgggctaaaggaaagaagagttgtagaagtaattaaagactcagtgaaaatatacatattctggaataataataaataaatgaggaaatagccctctgaaagcagcgcttaacttgtttttgaggattttatacagcattagtttcatgattgatgatttttataattttgaagttcaatggaaagttttttaaaaaaaatattcgagaaagatggctgggtgtggtggctcacacctgtaatcccaacactttgggaggccgaggtgggcagatcgatcacctgaggtcaggagtttgagaccagcctggccaacatgatgaaaccccatctctaccaaaaacacaaaaaaacgagctgggcatggtggcgggtgcctgtaatcccagctactcaggaggctgagacaggagaatcgcttgaacccaggaggcagaggctgcagtgagctgagatcatgccactgcactccagcctgggtgacaagagtgagactctgtctcaaaaaaaaaattatttgagaatgatagaaagatgcacatttattcaatatgacgaaatcaggtggtttaggaaattaataatgtttttatcatacaagttcagtgatttgaaaatatctaaggatagacctggattccagtttggcacatttggatattttagtctgaatgaattagtattatttgatcatatgatgttttaaatacaaattgtcacatatgtatattatatgtatgtttaataattgctacccattttgaagtcctttagaatggaagaaacttgttaaatgtgtatttttgttcacatttgtagatgctttaaaacgagttattctttctctttaatttagggaatatcaaaactatcagttctgttttacagaagcacaatatttggctaggagaatttgaagcatttttggcctttagaattgaagttggtgtttttggaaatatttctgaactagaatatattattatcaatgttgttgctttatatattttatcgatttgggaaaaattaattcattttaaaatgactgcttcaggttttttccccttatatttcatttggcttctatttctatttaatttgtataccagggtaagaaatagacataatgaaatgatgactcaaatgtcaaggccccctgccaattccaataataaggaactgtgctcattgaggagatgcaattatcatttaaacatgttagtggcagtttaaaaataaagtaataggcaggatttttagttaaaataaggatagaaatctactcatccttatatttatttctgcttactcacctgagtttgccagaatgggacatttgagaggttacagttgccccaaattgatactatggtcagtaaagttgtcacatacagtcttacccagatgaataacatttttaaattagtaagtcatcaaatttcacatttacagtttattaaaacatggaaagaagaaagaaaaataatatgtaaaaattgtgtttttgttgataaatttgactttgtcttcattattttccccataatagctattcttgttaatgtatacctctatgatgtctgaagtctctaattttttagttggcttttataagaaaatgctattttaaaataatttatatttattccttcttctaacattgagggctctcataatttaactgttttgtttgtgcatttaataccaatgaaccactacgtctgccataaaaaaaaaaaatcaagagcaagcatgtcaccgaggggcatctgacgcagttatcagtggcaggattcaacagtcttgaggttagaaaaaaactcttccagatggcttgaccaagctttgattctatcacttggtttcctctacattttctctaagtgatcatccatgcctcacatattcttctctctccctattttctttttcctcattatagtattcgtatgttttcatctttccctaaactcaacttcctgtcatcatcatctttccttatcagatgtcaaacattaagtatgaatgaattggttgtttttaaaaaacccaacagattcagtgtagagaataaagactgaattaatccatgttaatttgtgctgtgtatttctttcattccatgtatatcaaatattgttctgagaatttggaaatgtattgcatagatcttttgaattacaagacattgtggtaaatttgagatgaattttttttgcagcttaatgagcagtttgcagttaatatttagtccatgtaaacataacctactgatatagattacaaagcttcttggtatggaatgaatcttgtttgagtgaatagctttgttagaaatgagagtaatagcacatagcttccttctctgccaggtaaggtcatgatgtgtggtgaaagtatcaacaggctgggagagaggtgtctctgacagccatgatcttagtaaatctttttaatgtctgcacctcagttttatacattggaaattaatgaacctagacaaactaatatttttactcctttacaaatcatacttaacatatatacatatacatgaggtcaattgatcatgattttttttttaattttttttttaatttttttttttggagatggagtcttgctgtgtctcacccaggctggagtgcagtggtgtgatctcaggttaccgcaacctccacctccctagttcaagcgattctcctgtctcagcctcccgagtagctgggactacaggtgtgcactaccacacccagctaattttgtatttttagtagagactgggtttcaccatgtttgaggccagactggtctcgtctcaaactcctgacctcaggtgatccacccaccttggcctatcaaattgctgggatcacaggcgtgagccaccgcacttggccatgaagctttctttcatctctatgtttcagtgaattcagatgcattttaaaagagaggtgcggagaatctgacttacctaccatgaagggatcatcttgttatcaagaattagttaaaataattctctggtagtttaggctgcctacctcagaaagttatttgggaggattaaatgacataatccatgtaaaattcttagcatctttgaccccagggataagcactgcataaatgttcattattacttctactgctattattagttgtgttcctttccacctataacagtctccgtatttattcccctattcacttactgccttatagatgaaagcaccaggtatcagtaggtttgataattttagagaaatattgagctcacctaacatcttcctaaaatatgccttggaccctgctgcttgtctccttaataaagactagaagaccacttgtcacacattctataggagctctgtttggatctgcattttatttacatactatcattgttttaaaatctctggtctctgtcagattgatgaaggtttggaatcgagttttcattacctgtatctactaatgtcttttatgttcatttatcagagcattgtgcagtaacttccaaaataaaatggatgtgttaacttaggcacaacctgaagcagcaacggattttgagaaacaataaataacatgagttcttttgacatttttttttagtagcatcacttgagagaactttaatagcaccttggaaggaacccagcatttgaaatacatcatccctgcgacagagcaatagcattgttattcatcttcacttttgttctcagggttggaactgaggaaaagcataacaaaaacacatttcttttttaattcccagaaatatgctctcatttgtcttattaattagaagctacaatcaaacgctgggaaacaattttcaaagaataaagtaggaaatgtctggttttctgtggccaaatcagttttcagaatactctcttatcttttctagacagttgcccacctttttctgaggcgatgattgaaaagtttttaagtatttattaatcttactataccataatgaaaccgttgaaagacaagtttcatcttgctgtcaagaatacattatttgacttcaaccttaatttaatttgagaaagtgtgagcatttcttctttgttcagataataatattttattagagaatttcaaatattgaactgtagttacctttagtgatgaacaacctgacattagagctttctctatacattagcagagctgagacatgatttcgttcagaattacctggagttcactctgttcttgtaagtatgaatgagacctttatttttaatttgtgtgttgcttacctttctctagaactgctctctgatcattgcccttttttcttttaatgtaatttattattttttaataatttgaacttcatctagattcagtgggtacatgtatgggtttgttacgtgggtatattgcatgatgctgaggtttgggctttgactgatcccctcacccaggtcctaagcatagtgcccaatagtttttcaacccttgtcccccctttcccatccagtagtcttcaatgtctattgttgccatctttatgtccatgagcaccaatgtttagctcccacttttaagtgagaacatgcggtatttggttttccgttcctgtgtttgtttgcttagaatggtggcctcaagctgcatctttttttatggctgcatagctgcatccagctatgtgttctttttaatggttgcacaatattccatgatatatatgtactacattgtctttatccaatccaccactgatgggcacctgggttgattccctgtcttcgctattgtgaatagtgctgcaataatcatatgagtgcagtgtcttttgagtagaatgatttattttcttttggatatataaccagtaatgcaattgctaggtcaaatggtagctctttttaacttctttgagaaatctccaaactgtttttcacaaacgctgaactaatttatagtcccaccaacaacgtataagtgttcccttttctccacagccttgccagcatctgttgcttttgacttattaataatacccattctgcctggtgtgagatggtatctcattgtgggtttgatttgcatttttctgatatttagtgatgttgagtatttttttatatgtttggtggctgtttttatgttttattttgagaaatgtctgttcatgtattttgcctatttttaatggtgttattttttgtttgcttaacttccttatagattttggttattagacctttgttagatgcatagtttatgaatattttctcccattttttaggttgtttactctgttcatttactttgcttttcagaagctctttagtttaattaggtcccacttgtcaatttttgttttgttttgttgcttttgggacttagtaacaaattctttcccaaggccagtgtccagaatggtgtttcctaggttttcttctaggattcttactgttcgaggtcttacatttaaatatttaatccatcttgagttcatttttgtatatggtaaaaggcaggggtcccatttcattcacctgcatacagctagccagctatcccagcaccatttattgaatagggagtcctttccctattgcttatttttgtcaactttgctgaagatcagatggctgtgtgtagctttatttctgggttttctattctgttccactggtttatgtgtctgtttctgtaataataccaagctattttggttattgtaaccttatagtatagtttgaagtcaggtaatgtgatgcctctggctttgttctttttgcttaggattgctttggttatttgggctctttttttggttccatatgaactttagaatagttttttccagttctgtgaaaaataatgatggtatcttgataggaatagcattgaatctgtagattactttgggcagtatggccattttaatgatactgactcttctaaactatgagcgacaaggctcatgtatgatattttgatgcagatattagtgatgttcatgctggttctgggtttttaaaaattagtataaggttaaaattgctgtatggtattttttttaaatgaaccacacaggaggcttaatggcattgttcctgtatagttactttattgtgtatagtaagaggacactgtacatgattacatgatgaattatgtattcccaatagtcatctataggcttaaagtgcttattttgccatatttaatttttgttaacaagaaatattgtagccctgagcataacaggaggtacctcctattggagatcagatttttatttagttctattaaaggtttgtaggttctcagggataaaaatcaatccctttagttaaaaatcatacagaatcttcctttaactgttccttttgtttttaagttagaatcattttagccagtagctttaagtctcagtgaaaaaaaaatacatgttttcaatgtgttgtctacctcttcattttttgatagtttcctgtttgttcttgtgtacttttttggtaagtatacagtgcaataatttttagtaaatgaatataatagtgcatctacgacaacaatttggttttagaaaactttatcacccccaaaagtttacccatttgcagttaattcctgctcctacctccaactgcagccaaccactggcctactttcatctctatagatttgcttcttctactcatttcttacaaatgtcatcatacaattagttatctttctttttcttttggtttgccatcatgtttttgagcttatctgtagtgtagtatgcatcagcagattgttaatttttcctgatgaacagtattctattgcatagataccacacggtttgtttatccattcaccagttgatggacattgattttccagattttggctattatgaataatgttgcaatgaacattcacatacaagagtttgtgtggatatgttcccatttctcttgaactgatttgcagttgttgcatcatatagtaagtacatgtttaatttttaaagaagttgctgaactgtttttcaaagagcttatgccatttcccatttgactggcagcgtaagaaggttcagcttttacactcacacctggtattgtcggtctttttcatcatagccttcctaatgagtgcaaagtggtgtcttaggttttaagttatacttccctgatgactaaagatggtaaacatcttttcttatactttttagtcattggtgtaatttctttagttaaatatgtaggcaaatattttgtccatacttaattgttgtttgctttcctattaataaattgtattaaaaatatacattctagatatgatattgtctttaaaaggtacttcctatgcagttgtcttttataatcttcaatttactgtcctttaaaaatatttatggagaaacttctgttcagaaagtttcattcatagaaatgtaagtctgggctttatcggtcaacactgtttacatatttcagtatctccttcagttgcacttgactttatcctttctattgatatcttaggttgaaataacagttttcctctggatatattctgtgtggccatatgctggtctcgaactcttgacctcgtgatccgcctgccttggcttgccaaagtgctgggatttacaggcatgggtcgctgtgtccagccccgaagtactttcaaaacaggaaaagatatcaaaggcatggcaacataacacactaggtttcttttcttattattttgttacagttttacttttcaaggattttgagatttggtataattgagttccagaacttagacatcaacttagtattttttcctatagcaacttttgaatcatgacttaagctacagcatctttctttttgcaattgggttttatggtaatttctaattattataattctgatagaaacaattagctttacatatgctttgatagggcatcatccttgagcaagcacagaaaaaaagcagtattgagagacagtattgtgtatgattaagaatacagtctctgtagaatggcttgaagccgggaggcagaggttgcaatgagccaggatcgcaccactgcactccagcctggttgacagagcgagactctgtctcaaaaaaaagaatgcagtctctgtagcaggacttcccaacttcagactgttatttactagctgggtaaccttgagcaagttaactttttgaagcttgttttcattgccaacctcatagtcagtgggcctctcttgtttgttcccatttctttttaaaataactaccacattctcctgacttccacaaatatgtttactacttgtttcagttttatcactgaagacatatttaaacattcccttagttgtttttctcatttttaatccttagttttgactaagccttactccttttgttaaattttagtatcattattcttagagaaaaatgccaaaatattaatatttaaaaggcatatctgtctatccattagtatttatctgtatctatgtatcttaacatttctggcactgttttaagtgtcttccatgaaaatgttataagaaaggagtgaaagctgctttcaaatatttaaatagttatcatataaaaattagataaagtttttgtttcagaaggcaaaaccagtgtcaaagaatagatgttataagaaagtagatttggttaagaattaagaggaactttccaacaactggagacattaaaaatggagggagttgcctagtgaaataaaggtctatataatacttgagagttcataaagaaaatgaatgacagtcactcagggatattttactgaagattcataaagggaacccaaactttaaaggtaaataatatgatcacgttatttttgtaatgctagtttcaggaatagggagagtatccatattataaacattttgtgctattgtgaaaaaaaactttgattctgttttcttttcatagcagatatggtttaaccttaaaaagtaatgaattggtggagtagagagatttagaaaagctttgactatttagcaattcttcttctttcaaagcttagtacatagtggcttttaaaattcaactcaataaagtatgtttaaaatgctgcctgtatttggattccaagtttagtagacaatttctgctcctcaaaatgcaatgaaaacttgatttctatgatctatgatgaataataaaagctgcctttaaaacattttatacttgtaagagtgctttataagaaagccacttatttacatttttcagcctccatgaaattgaacctttaagaaatgctaaaatagtaaacaagtaattaggctatgagttattaacaagttttatttcagtttatttagttgttagacaaagctagtttacacatttctattatactggtggctaaagattatgatcacttattagagagatcagtttctattgtacttataacatgattcagaacccttcattctgtttaacagcatttccttattctgtgaagaaatgagtacagtttaccacattttatttttctgaaaataatcaaaatccaagtacagtcatacactacacattgatggtttagtcagattgactgcatatatgacagtggtcccataggattgtaaagccgtattttatcataccttttcaatgtttagacacaaaaataccattgtgttccagttcttacagtattcaggatagtcacatactgtatagatttgcagcctaggagcaataagctctaccatttagcctatgtgcattgtaggctatgcctctaggtttgtgtaagtataccctgttgttcatataatggtgaaattgcccaacagtgtgcttctgagatgtatttctcttgttgttaagtgattcatgactgtatttatgtttgaatcatacaataatcttggttcgttttccgtttttcctaatgaagacatggtggttttttttttttccttggagatacaggggggtcaaaaatctgagcatattgtaggtgacaagcagtggaagttgattccaaaactcttgctttttgaaggagaggtcaagaattatatttcttgtcagcacagactcatctgtgaagttgttgttggctgatgttaaaaatgcttgtaataacatgtgtaggttcttcaaaggattgagatttcaagcttacatgtctcaaaattttgagtgaagcagtgactcttttttggccattgaacaccagcttcagaaatccttccatccactgtagaagaggtgtgagggaatctctttctctctgtgaacatatatggagaactcatactatgatttatggcagcttgcattttcatatttttctaatttagatgttactatgaataaggtaggtgtagatctaacaatagaattgccataaacaggagttagaaattcttaacatcctacagtaaaagaattttgtgctactctgatacattttttaggtaggttataaattcttatcttactatcttaatatgactaattatgacagctatttttcagtagtttaattaccattctaccctgttctgtggttataaagacttattccaggccgggcgtggtggctcacgcctgtaatcccagcactttgggaggctgaggcaggtggatcaccaggtcaggagatcaagaccatcctggctaacatggtgaaaccccgtgtctactaaaaatatatttaaaaaaaaaattagccgggcgtggtggtgggcgcctgtagtcccggctactcaggacgttgaggcaggagaatggcgtgaacccggaaggtggagcttgcagtgagccgagatggcaccactgcactccagcctgggtgacagagcgagactctgactcaaaaaaaaaagacttattccatacaagagtttattattctgtgaaataatatatattattttatgtacaatgtttacattctatgtcaactcaaaaagaaaattttgtgaagtttgtgttcttatccccccagtttatagaaataaatagtacctaataaattatttatagttctcttgcttgtttctctataatcttgattttttttttgagacggagtctcgctctgttgcccaggctggagtgcagtagcgcgatctctgctcactgcaagctccgccccccgggttcgtgccattctcctgcctcaacctcccgagtagctgggactacaggcgcccgccaccacgcctggccaactttttgtatttttagtagagacagggtttcaccgtgttcaccaggatggtctcgatctcctaactgtgtgatccacccaccttggcctcccaaagtgctgggattacaggtgtgagccactgcacccggcctctaatcttgattttatgggattatgtatttcaaagattttacattttaccctgttaattttttttttgtttttaagtagatacgatttttaaacttgaatcttcaccactgaattacagaagagaatgcacaattgtccattcccttctgttatttagtggtgaagattcaagtttaaaaatagagaaaatagagaaaaaagattattgtgctgttcctgatggggatcattggacactataaaactgtgtttgattttccttaaataacatgattttggaaactttatatatggtttgatcactttagttttccccagacatttctttcgagtgaaccattgttttacagtgtgacctccggggcactgccgatactcggtttatggggctgcttctcaccactatcatataacaatttaaattaattaatttaaaaaatgtgttcggagccttctttaagtctaaatatagagtgtatgtctatctgctatgtttcccttaactactaatttgataattctaaggggaagagatgattcagtgggtctggtatgaactgttctctataatctgagcaaggctctgacctcatctttcctgaaggtggaaaaatggtctcataaatttctttttttttttttttttgagacagagatagagtctcactctgtcacccaggctggagtgcagtggtttgatcctggcttacttcagcctatacctctcaggttcaagcaattctcgtgcctcagcctcccgggtagctgggactacaggtgtgcacccctaggcccagctaaattttgtattattattgttattagtagtagtagtgaatacagggttttgccatgctggccaggctggtctagaactcctggcctcaagtgattcgcccaccttggcctctcaaattgctatgattatagacgtgaaccactgcgcccagcctagtctgataaatttctagatgtttttgttattatgtgtataaaaatggactgaagtattatttcctatctttacacttgttaattcttgactcattatacttacactctatttacttttacagatcatactatcataggtgagagggcttcctgggttaattttcaattatatttcctttaccccttaccctaatcagagattgctatcaccagaacgaatggtttatttcaaaattctacatttattttatttaagacatttcattccccaattttgtctatctcctttgtcattgtttgcatttaatgtttggattgatttttcttggaatggcataggtgaattgactaagacactatttttagcatattgtaagtttcagttgtatttttcaaaagcacactttatgactgggaagaagcttttgagtgttgatagcgtggagtctcaagattgcttatcagaccaaccgttaacttatttataaactattatgtattataatgtagacaatatatttctttatttttagtataaaatgtcaaaaatcattgtatttgtcttgccaaaaattagggtaaaaatgatcatctaagtatttattccacttatgtttctactagaattaatcaaaacacttaaaaatctatttttatttaacttgaattggaggcccagaatctatgacatcatttaccctttcataactgaggataatttaaaacagatttcatacctcttggtataaaactcacaggcagtaagagacagaagaatgtgctctaaaattctaccagtgcaaatataaaacaatgttttattacagcagttattctgaataattgatacagtttatcaaagtttaaaagtaatatgatttttctttaaagttagtggctttcagtttctggttgaaatctctctctctctttctcctctctctctgtctttctttctctctgtctctctctctctcttttgaaaactttttcaggattttaatggactttgataagtatggaatgcaaattaacctgataagcataatagtttcttcctaccctttcaaagattatgattattaaggtgatgatgatgatacatggttttgttttgttttgtttttttgagacaggatcttgctctgtcacccaggctggagtgcagtggagtaatcttggctcactgcagcctcgacctccccagcctcaggtgatttctcccacctcaggctcctcagtagctgcaactacaggtacgcaccaccatgcccagctaatttttgtattttttgtagagatggggtttcaccatgttggccaggctggtcttgaacctctgggctcaagcgatccaccctcctcgacctcccaaagtgctgggattacagacatgagccaccaagctgggcgatgatgtgtatttgttgagtgcttagtagcaggccctcttgtaaacattttatatgtattatcttatttgactcccgttgcaaatatgtgaggtagagacatactaaggcctacttcttggatgaggaaactgaaatacaaagagattaagaaaacttttctaaggttatatagctagtacatgccaaggacaatattggacccaaatggtcaggctctagatagagcctgtgccacaatgcgtggcctgaaataaacttcactagtgtattcttctgaaagaatatcacacaacatttattgcaaaaaagtattatgataggctctgtataaagttcttatttttatggagtctaggatcaattttgggaatgagatataaatatatgtagagatcatgattaatgcagaaggtataaagaagttgtccattgaactataatcagtgtgagcttgtaatgttcttcctttgagataagctgaattaaaaaatgttacatttaagtaattattttgcttgtcctatggacacaagtgtagattatagtaattgccagtagattatactactgacaatttgtaatttttaaaaatgttatgacaaaacatatgtgtactgcttctggaaaattgaaataagtttccttcctaccacctattctaaaatcaaataagaaaattcctaatatcatcttgattgctttatgtaacattcgtcaaagatttaagaatatatattttattcttataattttggtttatctcaatagatggatggcaagacttatctttgtcattttagttttattttacaaatggtcttgggaaaacctgtcagtttttaccccacgaaaatttcctctgatatatggtagttctttcaggttccagattagtttaatactttaaaacttctcaacctttgtctcataaggcttttattttattttataacctgttctgtctcctcatccagaataaatttatagtgtagtctattattctactccctattttcttcaatatagttttcatatattgttaccatcccccttttatatgtcaatatttgctaaagtaaaaattaaaaaaaatctttctcctaatgtacctttttgtcatatgttttaaaaaaaattgctgcaatattgcattaaacttgtacataatgtcatattgacaatggcatgtttacggggatgtgtgattgtgggccttgcaaaggagtccttggagttcacctaggccagtcacatgtaggacacatttatgtgttgttttcatctttcatgtttttcagtcagacatgtagagttttgttcattattttatccctgacatttagccattgtctttgcatacagcaagtgtttaggaaatgtttgctaagcgagcgatctaaggattttgtaatttattctgttttgttgttaaggccaaactaggagaatacatgtgatagcattttaaagggcactgcttatgtaaggtattatattcgatacaattattcatccattaattagtgattacatttaaatgttcactgttaacataaaataatctgattacttaaacaatatttctccaatatacttgtcattataatctgcctggcataaattgcaaagaaaaccctaatgaaatcatttcctagtgggtccccagttttggctattagtccaatttcagtcattgcccataacatagcaattcaatgttattatatttccttttcattttctagtatgtttctacaacaggtagtccgaattttgacctcgagtccctagtcaccttcctttatcttctttcgttgccactgtcgcctgtgtatattcagtcagggttcagttcaagaccatttttgaacgtttattccattgcaagcacattgggagtatacatgtgaaatgacagatttccagtcctaaaggaatctcttatcattaactactcatatatatttaaattaaccactcatatatttattaaattgtgagtacatatatatatatatatatatatatatatatatatatatatatatatatatatatgtagttaacaaagcactgaattaccattatttgagagtaattataataaggacaatttgaataaaagaaacccatgaagtatagattttttaaaaacatatatatatatatatgttcgtgtgtgtgtgtactcacaatttaataagagaggcatataaacaaatatatgtatttatatacaaatatatagttgaatatatacatatatatttgtttctgtgtctgtcttttattaaattgtgagtttcttaaggacatgaattatatcctatccatctgtgtttctttagcacccagtacagtgcctggcataaggtagacattcaattgttgaattaagaaacaaagactttatcctatgtttggagggcacatataaaaatatttcatttataatcctcaattcaaagtcttctttcaccttaacattttaaagtaaaagggcaggtatttgtcatccacactttatagttgaagaaacagagagacaaatgttgtctgatttcccatatgctgtggtgctagcaccctcgtctgctgatatctcacttagaatcaatttcatgaggaaagcaacctaggcaaaaagctaattgtacaagtgttaaaagttcatcactttttcaaattgtatagaataaatgctttttgggggttgagctgatgtgcactttatgttaacattttacttagacaaagaaatgagtgactgtcttagtaaattcagtaattttattaattcccaagagcctactttgtactagtcactgtgttgtgccagatgttagagatatgaagatgaatacaacacatgttgttaatgggctttcactcaagtggaaggcaaaagcaaacacattgtggtaacccctaaaatggaaggggtttgtttgtttttttgcttgtttgcttgctttaccaagtgtttacaatgagcaaggccttggaataagcattttatagacacagttttatttactctttccaacagccctagggggtaaaattactatcgccattttacagacaagaaaattgaagtttgactattgtgttgtggggccatcgatgagtggacaattggttctttgtgaaggaattggagaaggaaactgggactaggagaatggtatggtcataatgggtcaaggaagagttctaaaagatttatttaaagcacatttttagtaaaagagtagcagtttttttttaaactagaattgttttagtcctttaatcatttttgaagccttttttggaccacattttgtcttaagatcacatgtctggcatggatccctgggaatatgcagaaaggacatcttagaatgctctagttggttagaagtgtggaaacagctgagggatttttctagtcaggtccagtaagagaagtgatgctgcaagttctggtcttggagcatttcaggatatgggaattgaattcagtgactatggaaataataatgagaaatccataaacaagttttaaaaataggtgacttccatgccctgtttttggcttttcccagggtatcatataattatattacattgcacatggattgagtaaggcagagtatgtaacagttgaccttatacaccctaatattttcactggctttagttcatgttgcaaatattgagttgattataaaatataaaaagaaaaatcaaaatgaggttcatcataggattctgaatgagacaatttcagagaaagcagagactccattgctttttattactagaatgtcattgctttccagtagctactgcattaccattatttgagagtaattattataaggacagttagaataaaagaaacccgtgaagtatagatttttaaaaaggaaatatgattttgttactgcgatcgactttattcagtactgtgaaagaaaccaacaacttaattttctgctgtttacttgagcttctaacaaaatggtaataagaagcagcttacaggggttgctttagtgtctatttaagtgtcatttgtaattataagatctgaatgataaacaaatggaaatgtttaaacaaatggaaatgtttaatccattaaacatggttcagtttcttttaatagattaaaatttccctcaaatcataatcatgtttacactttcaatgcttaataaatttacactccacccatgttaatgtattataaattttgagttggtggaatgtgatttaatacttaatgacaaaagccattagaagtttttctttttatcttttactaagtaatattttatacagacaaaagagtataatcgatatgtaatataaatgtaagttatgaagcataaataacgtaataacctgtgaatccactgcctaatgtaacagttaaaatattcccaattttatactggggaactccctgcatccactttcttcactttcttcccagttctgcactgctccatccactgaaataaccattctcggtttggtgttattgccctggtgtgtgcgtgtgtgtgtggttttttttaatggcgttcccctaatgtatatatctgtaaatacatttgtttacttttacttgtttctaagctttataacaaatgtaattatatgtcagagatttttgaggttaggtattagctagtttatctattgcccaatgagtcaacctgtaattttttgaactgtggtttagcgcatctcaatttttaaagtgctttaacatgttttcttggacatcttcacagttgtccttgtgagtaaagcagtggaggtaacatctaactcacttacttttggtagataaactccatgaagagtaagctcagattttaagaaatgaaatgtggcttctctgtagtgtgaactcatgttattctcttctcttcacactgttctagccactctattttccttttatttcctcagatatgtaaaccttttttctacttcagggattttgcatatactgttcttgattcctaaaatactcttctacctctttttagcatcactaacttaatttttgtccttcagatctcaactgatatttgatttccttccttgaccacttcacctggggagtccacatgcctttattgtctattgttagttttccacattgcactatgccaatttttttccagcttgattgaggtataattgatgaataaaattatataaatttaaggtgtatgatgtgatgatttgatatatggatatattatgaaatgattatcacaattaaattagttaacacatctatcacctcaccaagatacctttttttgttattatggtaacatctaaaatctactcttttagcaaatgtcagtgtacaatacagtattgttaactatagtcatcatgctgtatattagattcttagaacttattcatcttaaaactgaaaaagtttgtagcctttgaccaacgtatgccaatttgtgattatatattcttatgtttcttcatgtttttgaacatgagcattggacaaaaaacatgagcaaacataacaatatataatcacgcttgttttttgtccggtgatttgactgaaagatccatgcaggcagagacaatgcctcctttatccaccaatatgtacctagtgtcttctaaaatgttttgcatataggaattcaataaatagataataaatgaatgtaattatagtctggtattaaagatgaaatacacagacaataattatttggctatatacctgggcagtatcgaatttaggttaaatatcagatttttaaagatgttgcccactttgaagttgtatatcccagaagatgataaatcaagattttattggctttctaatattgattatttgaaatgctaggtacattgtacacttgagtgggtaactaccttgtaattcattgactggaaagaaagataaaaagctgttaaccttttttacttgtcatgagatgaagtgtgcacaataaatcttttctgtctttagttgtttgcctgggtaagtgatctaatagattcacaggtcttgtcaccaataaattttgaaaatttcctttctttttttgtgaatttgaaattaatgtgacatgtgtaatgtctctgtgtgtgtaatgtctatgtgtgatgtgtgtgcacgtgtggaagagagaatttgtgtgtgtttatgtatgtctgatgtccatggcgaggaagaatatgcaaacaaatttgagttctgttgtctccttacaagtaaatatgtagaattatgcattgtttaagagtaggattttttaaaaaatggtgtgttgggtaaaatatttgctttcaaagagcagaattaaagggaaggcaaattggacagttgccaagtgctgcattcaatgtggggctctgcagtgtcactgcaaatgtaataaatagagaaaattgcatttaccacaattttttttcaaggagagaacacaggtggttgcaagtaaatctgtggtgtgctccatcataacagatagtccttacagtgccccccaaggagaactagtgaactgcaggcatgttttgcagagctgggcatgcaaacaggggcgttatacccttcgttctccttctctgttctacccagagcagtagttcctactaaatgcttaaagaatgtttaaattattttatgagaatttaaatttgaagaggaatcacattattgtctgcccatggtacccacttctccttgttgggctttgctaatttcttttttttttttttatactttaagttttagggtacctgtgcacaacgtgtaggttagttacatatgtatacatgtgccttgttggtgcgctacacccattaactcatcatttaacattaggtatatctcccagtgccatccctcccccctccccccaccccacaacaggccccggtgtgtgatgctccccttcctgtgtccatgtgttctcattgttcaattcccacctatgagtgagaacatgcggtgtttggttttttgtccttgtgatagtttactgagaatgatggtttccagcttcatccacgtccctacaaaggacatgaactcatccttttttatggctgcatagtattccatggtgtatatgtgccacattttcttaatccagtctatcattgttgggcatttgggttggttccaagtctttgctattgtgaatagtgtcacaataaacatacatgtgcatatgtctttatagcagcatgatttataatcctttgggtatatacccagtaatgggatggctttgctaatttctaagagcattgcctgatctatctggctgctgtttacctccaaccccttgtcttgtcactctgtaccataagcagtctcatccagctgccccaatcttgcatcttttcctaatatgctaagctccttctggttgccacagggcctttgaatatgctgcttgtttcgtctgaaatgctctttccctaactttttaaatggcttcatagtgctcagattttagcttaaatatcaactcctcagaggggcatttctcttgctctatgtgaaatagaagtagcccagtctcagtgctctgtttattttctttataacactactatctgtaatgatttgtttctttattgtcttgtgtcctcactaagatgttagtgacatgaaggcatgggcctaattgcttattttgtttttcatcttgtattcccagttagctcctagaacaacattttaattacataatagattctcattaaatgttttaaaaattaatttaggaatgattggtattcaattctgcaatttctagtttgtacattctaattttttatatcatgataatgttttatttctgcaagtgtttataaattttatgtaagttgtctttcatatgaaagagcagactcagcccaggttttcctgtgatgatgtcagtaatcaagatatatctggactgaaccaacgagtcagtttacttagcagtagataaaaacatgacagaaccctgctacgctaattggctacttattcttctttgatgtaaattttggtatactacctttatctaaaaaaatacatatatatctatgttcatgtgtacttcaaaactgcatttcactctagttaaaatatggctcacctggtttaagcacaatctttaagcaggaacatgaaggatatcttgaaatctcttccatatttataactgctgatatttgagagtctgtactacgatccaggcccagggctacctgctttgatttcttacttatatttaatactctcaacaaccaaatgagataggtatgattttatcaatgtggattagagagagtcagtaatttataacatttgttttacatatatagactgatagactgataatctgcaacccatgaaaattttggatttttgctaaataaatctttgatttttccctgaacaactaatagacaggattgatataacagctgttgtcatttatgattctcaaagtagtcttactatttaaccaaaaagtactttatgcttatgactaaattgtcaactaaatcttttgtctttttatgtttaatcaaaggaatactttgtaggactagtgtttagaaagctgtctttataatcagagtcacaaattagtgtgctgatgttagtgcattttgatcatgtcctttatgtatcttatccccttactttcccttgttccccttcatggattttttttttcttttctttacagtgagagtggcagtaaccatgacagataaaaatgttgtgtatatagaagctcctctatttcaggttaggtcccagaaggctgtttttcagttgttcttaaatccaaagtggcttaaggggtttcagcttgtaatgctcaaatgcctttccaacaagcagttatgagatttaaaatgcacaaatagtgtgaaatcttaaaatcagacatagttctttttcacttggtttacgtggctcatttatattaaaattgggttgaacgaagaagcaccctttttctatgatctctgtaagtaacttagaaatgcttcagtgactactgaatttacagcgagataatcaccatgtttccttcatgttcttgaataaactttttaccttgcccaggattaaaattaggcaatgttctagccacattttacaaaatgtttttttatctcctgctgatagactgtcagttgcacaatgtggcacttttacatgtgttgtcgttttttagtggttgccctagatttttcaacccatatttccaactaatctaaattcactttcaaatgacactgtattgcctcgtcggtagtacagataccttgtaacagagtatgcccaatccctccctccctgtcccctataaggttgctgccattcttgtcacttatccatatgctttgatccacaggctatattcaggcaatacattgttactattattacttttaataaagttgtctatcaagtcagttaagaacaaggaaaatacaatattttattttaccttcattctttctccaactctctttctttcttcaaaaagatccaagtttctgatctgtataatttttcttcttcctgaagaacttttttaaacatttcctgcagggcaggtctgctagcagtgagtttcctgcttttgtttgtctgaaaaagtctttatttcttctttacttttgcaggattgctgtacatacaattctaggttggcgtttttttaaatttcaacataaaatgtttcagcccactctgttcttgcttgcattgtctgatccaagaaaagttgttgattttctgtttgttcatctttttttcttgttggaagatggagtgacaacttacaaggtcttcacatgttagagctgaaactagaagtccctttgtgacttactctttgtctttcaaaatactttatactgttgcaaaattccaaatacccatgaaacatttttactcttctcatattttcaatttttaaaatattatctttatttattttctcttgtaattatttctcttctcagattttcaatttttaatatatttatttaattttccttgtaattatttccttgtgattattatttttatttttatttaattttctttgtaattatttctctttttaatgttgtatttgttgtatttgtacttactggacgtagcatggctagtgacattcttaaaatacctcaaaatcaaacatagaaacaccaagccaagtgaagcctgtttacaacatgttaaggtaactaaacatctgcctacttggctgttatcaccatttgttgatggcatcagagtaattcagtagctgaattttgtttgtctgcataaaaaacttataaagtagggtcactttcacattaattatgtacattaggagtggcactataaatggatatttggtgggagtaaatgaaggatagtgtgacccattaagttcaagggcatgtcactcagtgaaaatctgtatagatactgatatcttcatgtatgttaagaccccctagtatatgctcccatagtattcagtgtaatatacttactacacagttgcttgttttacttgcctgtctcccctacaaatagattttgctttctgtctcactggccctctctctcttttctccttccctccctgcctccctccctctctctctctctttctttttctttctttctttctttttttttttttttttgctttttcattacctgattgaaatcaatgacccaacaaacattagcactctttcagtctttagccaggttatgcttgatggttgccgattaacatttagtactttttctatgttgtggctaaggaacactttggccttcaagcataaggtattttcccctataggaaatctctttggcatttaattaagaataatttagtgggatagtcttgagtattttaactttaatgttgagatgaagcaagtcatgcttataaatttacatagcacattaggtctacatctgtctagcctcatttaggtactggatttgtattttgaagagctgtactttgatgtctatgtgtgctatagtttgaatatggtttgtttgacccttccaaatcctatgttgaaatttaatccccagtgtggcagtgctgggagatggggcttagtgggaggtgtttgggtcctggcgttggatccttcatgactgaccagcttggtgctttcctcatggtgatgagtgagttctcactgtattagttcccataataactggttgttaaagagaggcaggcatcttccccctctctgtcacttctattctcatcatgtgatcactgcacatggcagttctcctttccactaatggcagaagtagcctgaggctctcaccagatgctgatgctggtgccatgctttgtgtacagcttgcacaatcatgagccaaataaatctcttttctttataaattgtctagcttcaggcattcctttatagcagtgcaagcgaactaagacaatgtgtttgtgtgtttcatagattagtacaaattgtgttaaaatatttgattgcttttatatatatatatatatatcttttgaaaaaaattccacaacataagcaaaacatcaacttacatttgtaactgtgtatagaatgctggtactgtgtctaaaaccaacatgttttcctaggtttggaaaatatcaccacagtgtgtttgctgaaggcaaatagtttgtgtttgtttgatacaaaatatttaatttttatgagagaatcagtggtagaaatcagtataggttttttggaagcaggcagatcaaactcctacttggctaacaatagttttcactgatgagctgattgttcttatgctgtgtagacagaactttagtcaaatagagaaacagaaggtttcattaaagggcacagttaacaattttctttttatacagcactgttcttttttctttataggttgatattttattttcattattatagcatccaagtgctgttagggcatagagaaatcatttcatctatttcattgacaggattgtgccaagcttattctcaagccttcataatgattgaatatagagaactgcacagttaaacctcaccccactgcagttttctcaaatttaaaaggaaaatttagtcgtgagtgtctgtagatggaagatactacagaatagagatttatactaacccctgaacctcgtagcactttatttggttctggggagaacatatttttttaaacaagagaatgcttatataggacagaggaaaaggtttgggttcagatggaattttggccttttctccatagatttgtttgaaaaatgctggaaagatccatgaaatagtaaatggctcaacaagtattttgaaatattttttaagtggcaggcagaattctaagttgtaatgtgtattgtatttgagacaatttaatcttatatttttgaggatggatttgcattgagaactggttaaaaaaaaagatgggagttgatatgaaatttaggtatgaattagtaagaaccagtgagttaatatgagctatagaatatagagaaagagttcaggtgattttcaatataaaacttatattgatttttattttcttttagcagctagtttgttggaggaatgtggcaatggagtacagatttcctgcagttttggatttctactcagactaattattagcaataaacatattagttcttccaaatattctatatggattcaaaaattagagcaaacaattggatgcaagtgattaattggaataccagaaatattagagtatttggttgttttgccatcaaaaatataatctaaatatgtaccataactttgaattttattttagaaacttctaaattctcaagataaatacaaatttgatatatttatgtatagttttcaatagtttgctttaaaaaggactttaaaaagcatgtatttccaaagcattgttcatgtttgtgcacacacaaaaataaggttcttccttcttgatagtagaacaaaaatattaggtgctgtgcatacaacttagtatcattttgtgaaactctcaggccttatatctcttgggattttaaaattgtaatttacatgcaaaatcaacctttgggcatttaaaggataattgtcgaatttaaggattacctaaatcctgtgctttaacttctgctgcttctgtttattgtttatttctttgctaattgttatcttctcagaggaagaagcggggaagaaggagagccttcaatacaaattagttaattttattactgatcgtattttgctaaagagtgtaaacaaaatgattaaagtgggtttaacatgaggtgtggctttcacatagtttttgttttccgtgttcctggatcatcaagaattttctcttactttgggctcagttttctagtagtcttcagtagaagtggctattgtgggaactttaaacatttttaatgcatttttatatatagtgaggttagctctaggtaaaaacattaaattgtacagcttgtattcagtatgttacccatttttcctaagagtttgtttttcttcttcaggttcctcttctcccctttattccttcccttccttcctccctctctttcttcctttaatacatacttactgaacttcaactatgtgctagaatgtatgtcttcatcttaacagtggagccctggaggaaatgttagttttcatggacaactaagggcacaatcagataactgcccatacattcagcggactggttttggtgcaagtgttaagtctccttctctcagagtcattatgttagctagggtaggttacattcctgtaacaaatataatcaacatgtactagcacaagcaaagttgaagtctttctcaggaaatagttcccagccaatgtttcaaattgggatgatgggggtctgtaagggaccaaggctgatgtatgacttcgtgggtctaagtcatttcggccaatgtaagaagatacaaagagtggagacctgagaacagtatgcataatttccattcacattttatagtcacatatccagactaactgcaagggaaactgagaaaaggaatataggcctgtgcctagaaagaagcggggaatgaattctgatacatgtacattgtcgtggagccatagtcatggatgagccagaactaactagtagttttcacaaagatattctggttttaatttaaaaaccttaaaaataagttctatgccttttttcctgtttacaaaaaaatgttcctagagctgcgtagtatacttattatatatataaacaatttagaagaatgctaaatctgcccctaatcacatagccaaggggatgttataatattgttgtatttttggccctttacatgcattttgaaatataatagggatcatactacatatagttttggattttttatttaaaactaatattttgagctttttccatgccacagatgtacgtgaaaacattatttactatggccctacagatttttgtcataaggatatactgtaacttaattataaatttattgatggaattcatattttcattctttagtgtaagtatgtttttagcgaataacttttatacataaatgcatacctgcatttctgattattagcttagttgacttggtgactcaaaggatgtgaatatatctacgtttcttaatatacactgttcatttgattttcaaagaatttatgccaatttaccttccaaagaccaggaatgaatgtgcccacaaagttgtgggcaattaccagatgacccagaaatttcattcttaggtattagcccagagaaataagaacttatgatcatacaaaaacctatactggaatttgcatgacagctttattcatattggctaaaaaccaaaagcaacccagatttccttaactgggtaaatggttaaacagcctgtgttacatccagatggaatactactcagccataaagaggatggagctattgatgcatgcaaaacttggattcatctgtagagaattgtgctgagtgaataacgacagccctgaaagattagatactgtatgactcaatttatataacattttttaaattaaaaaaagaacaggttagtggttgccatgggttaaggttaaggggaggagcaagcagggaggtgtgtgattataaaggggcaacaccaggactctttggtaagggaacttttctgtctcttgattatggtggtggatatgcaaacctacacatatgaaaaagttgcagagaatgaaaagcgtacacacacacacacacacacacacacacacacacagatgagtaccaccaggaaaatcagatagatgatagattttatcaatgtcaatattgtttccaatgttgtagtacagtttttaaaggtgtaaccattggagaaatgagtaaagggcatccaagatctctgttatttcttgcaactaactgcatgtgaatttataattatctcaaaataaaaagtttgattaaaatgtagtgcacaaaatttattatatagcttattatcttttatataataaggttctgttgtttgatgatgtaaacttttctgtaattgtaattaggaaattatccctttcattcattccgcactattcctggttggtatttaaatgttctgagaccttttcttgtttccatgcccaaattttcttcttttactttttagtaattattgtgtacaacagcaattccaaaaatatttcttcaccttcttctagcctttttgtggaacatatgatcccaaatatttcattgacctattttgtagggtagctcagaccccagcctattttttacatttttatttttgttttctttaaatgtaattgccaaaggatttctggaccagccctggttgatttagtgcctaaagaactggtcgtacctatttatatcctcttggtcaataagttatgctgttaaagtgttcttttattttattacaaaaagaatctgattttattcacttttttatttaagagttgctctaaataggataattgagtaatgatattcctcacatcttcagtttaaaaccctttatcatcctctctctctgcaaagtcctttttttctttattcatatgttatttatcacttgtttttttgtcaccggctctcactccaatactcccactcaattttctgctttatgtataggtatatccttgtaaaatttgtaacattttgcatgcatttcacatttacataaatattattgtgcctatatatctttttaagtaatttagttatataaagatctctattctacataaatttcatatgtttgttgagttcttcagaatattcaactagaattttgattaagactacgttatatttatagattaatttgagaaaaattgagtttttcactatgtttagtgcatgcctagtaaagaaaggtctaatgataagcagtaaaattgataatatctacgtttcctttctcttttaagattttaatgagggaccccaatgccatttgcctaatatctctttgatggtgcttttagtatccagactttaattatttttactacatttggtgtacatgaactaatatttagatgtgtgttatactactaacactgaagtttctgttataatcctaataaagttctttcattattgtatttggattgtgtaattttcatttgcagaaatctgccagaaagatttgaaactctatttatatcttcttgagattgtgtggataaacttacatgcataaagataagaattgctgtgtctccatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcacaaggacaaaaaaccaaacaccgcatgttctcactcataggtgggaattgagcaatgagaacacatggacacaggaaggggaacatcacactctggggactgttgtggggtggcgggaggcgggagggatagcattaggagatatacctaatgctaaacgacgagttaatgggtgcagcacaccagcatggcacatgtatacatatgtaactaacctgcacattgtgcacatgtaccctaaaacttaaagtataataataataaaattaaaaaaaagaattgctgtgtctcagccatagctagaagaatcccagacaaatgaattgtcaccctaaaaaaagacatcagagaaaaatatctcctaatacaatgaatgtatttgggagtaagcaaaaaaaggattcaggcacaactatggcaagccataggtgcacctgaagaggggagtggaaggggaagcttttatttggcaaaaagaagttaatataagctgcttggaaacaacagttctttggttcaggaggctcagaaatggagttggtgtcagttcatcagtggagctgctgttactaggcaagtggtctttttattttaaatttaagttctggggtacatgtgcagaatgtgcagttttgttacttagatatacacgtgccatggtggtttgctgcacccatcaacctgtcatctatattaagtatttctcctaatgctatccctcccctagtccccaaccctctgacaggccccaatgtgtgaatttcccctccctgtgtccatgtgttctcattgttcaactcccacctatgagtgaggacatgtggtgtttggttttctgttcttgtgttagtttgctgagaatgctggtttccagcttcatccatgtccctgcaaaggacatgaactcatcctttttatggctgcatagtattccatggtgtatctgtgccacattttcttaatccagtctatcattgatgggcatttgggtcggttccaagtctttgctattgtgaatagtgccgcaataaacatatgtgtgcatgtgtctttatagtagaatgatttataatcctttgagtgtatacccagtaaccggatttctgggtcaaatggtatttctggttctagatccttgaggaatgggtgaacacccacaatggttgaactaatttacactcccaccaacagtgtaaaagtgttcctatttctccacagcctcaccagcatttgttgttgcctgactttttaatgatcaccattctaactggtgtgagatggtatctcattgtggttttgatttgcattgctctaatgaccagtgatgatgagatttttttcatatgtttgttggctgcataactgtcttcttttgagaagtgtctgttcatatcgttcgcccagtttttgacggggttgcttttttcttgtaaatttgttgaagttctttgaagattgtggatattagccctttgtcagatggatagattgcaaaaattttctcccattctgtaggtttcctgtttactctgatgacagtttcttttgctgcacagaatctctttagtttaattagatcccatttgtcacttctagcttttgttgccattgcttttggtgtcttagtcaggaagtccttgcccatgcctatgtcctgaatggtattgcctaggctttcttctagggtttttgtagttttaggtcttacgtttaagtgtttaatccatcttgagttaatttttgtataaggtgtaagcaagtgttcttttaaaagcatcttatacgtgttgctgcagttctaaagaataactagtgataaaccttgtcacagaaatctgtacatacatgcaaaacataggtcatgaaaagcatgagctgcattaaggacatgaaggaatttctcatggggttattttaggaagtttttgagatagttcttatctcagacatgtgagcatgagctgccctcctttgtgctttcctggctctaatttgtttagaccggccatgagtgattccatcctggtatctgcaacttcacagggtcttggcttatttgggcttcttttctgtcagtgataagtgcttgatcccaattctctaagtgatatggactgagttgtgttgcccccaaaagttatgtgttgaaggcgtacccttcatgtaactgtattggagataaggactttaaagaagtgattaaggttaaatgaggtcataatgttggagccctggtctgatagaactggtgccctcactagaacctgacaatgctaccatctgatcttgtaactttcaacttccagatatgtgagaaaataagtttctgttgtttaagccacccaatctatgatattattgcagctttatctgactaagacactgtctgacattagagtgattgtcatattaattaatgctctgggagatagaattatgagtcagctttctattagaaatgattttataacagtctatttttgttctagggtgtttaggcattaaataaagtaaatgatccattggttgtatctttccatgtttgccgactcttaatgaactacatgaaatggcaactaccttttctagccacctcagtgccttacattcatggttaggcattatgcatcatttcctgtcttttctgacactcaggatatgaaattattttgccatgtaattcaattaggtcactgaaacactttgtgagttagacttctgtaatgcaaaatcgtgttgcttatatatcttcattttttttcagagcaggagtcatttcaagagtcagaactacctagaaagtaagataattacacttaattattttttaccaattggcatcatactttttttcctcaaggagtcatgtcatagcaatctgatgtttctcctctctgtttttttttgagctctcactctcagattgaatatattaaagttgtagtagattttggacctaaataaaatatgtattttctcataagtgtgggaagaatttttgtcttttatttagcttcatttaacatctacctcagtgcctgaaacattttaggagactagatggatagatatttgttgtacattaaaaaaagctttaaaaagcccatcgtatcaaaattaattcatgtaaaaatttgaaacactctgaaattgattgttaagtgctcctcaaagagtaattttggcaaacatctccaaagaagttcatgaaaacttctgagttactgagacatagatgtttactaacacagtaatcagtggttacacattctaaacatttaatcaatgtaatggaatattgagataacattataggaattacacaattccattgtcattgtatgtaaggaaaacagtgaaaacttcttatgataaacactttcagtatgttacttatctccattttggatgagatacaggccaagtcctatatatattttgctgctttgtggataattagccgcagctttgttcagaaaaggtggaggtaagtgaggaataggtatcagacatctatatattgttttataaatttttttgtaaaacattattatcagtagctctggctttgtggctgctgtcaaataaatttggttacttataaataactttaggttagactatgatagctatgagaaatttgatggctttctgtttagtgaagcagagtataattctggttattccaatgtcctttatttagccacaggttgtgatttaatgaaaggtttaggagctggattggaaaaatacttcttaccttctaagaaaatgttccacatcagctatgttatctttatattattagctgggaattatgagctgctatgttgctactattcttacaagaaggcttgcaagcagttgtagacaattttattttttgtgaccattctgtggcttgatggtaaattacaagagaggtaataacacttcacagaaatgtctttatcactttctatcatcttccctgcccttggcagtctcctttgctatttagatgacaatatatactcagagtttgtattttaaaaagcatgactctctgttcggatagtatctagcaatttgaaaccagatagcaaaatcattttaaaaaaccccagctttcgtttgaatggttagctacagattcaaccagggcctgaggactatgatgccttaaagtggaccctgaccaaagacttcaaggtaaattctatgggtttattagttgtcttggttttatgttttggtggaatataatccacaagacatgtaaagctgaaatgtaatataaagaaattccatatcattgtttctctagagatagttcagtaaaggtcaaagtaaattgaatcaagatagtgaggcaatacagttgaactgagaaaattggatgtggccagacagcattaaagaagagtagaatgaaattgactggctgtgaaggcttcagaaattggtgatgagttttttttttatcatttcagaagatgtaataattattagataatatttatttagcattctgctgttgggactttggtggcatctttaaaaaaagattttacatatttattttatccttagaagtttacattctaaagaataaaatcagtgtttgagcacagtaagtcattggacatatttgaagttcagttagagttcttatatttgaaaagttttgcaagacatagattcataatcaagaggcatgtactgtcgtcccttggtatctgtgggagattggttccagggcctcccatgggtgccaaaatccacggatgctcaagttcttgctgtaaaatagtgtagtatttgcatataacctatgcacatcctcctgtatactttaagtcatttctagattatttataatatctaatataatctaaatgctacggaaatagttgtattgttagggaacaatgacaaggaaatagtctgtacatgttcagtacagaaacaggtttttaaaaaatattttcagactatggttggttgaagctctggatgtggaacccatggatgttgatggccgattataaatactttcactattatgatagaaaaccagcagcatgtgttgatatagaagctgcaggagatccagaagatctagctaagataattaatgaagacagctacactcaacaaaatattttcattgtggatgaaacatccttctattggaagaagatgccatctaggtaggactttcatagctagagaggagaagtcaaaacttcaaaagatggtttctcttgttaggagctaatgcagctggtgactttaagttgaaaccaattttcgtttaccattttgaaaatccttgggttcttaaaaagaatgctaaatctattctacctctactataaatagaacaacaaagccttgatgacagcacatctgcttacagcatggtttactgaatattttaagccaagctttaagacttaccgctcagtaaaagagattcctttcaaaataatagtgctctttgacaaagtaaatggtcacccgagagctctgatggaggtgtacaaggagataaatgttgtttgcatgcctgctaacataacatcatttatatagcccatggatcaaggagttatttcaactttcaagtcttatgatttaagaaatacactttggaaggctacagctgccatagatagtgattcctctggtgggtatgggcaaagtaaattgaaaaccttctggaataaagccgcaataaatatacatgttattgcggcactattcacaatagcaaagacttgggaccaaccaaaatgtccgtcagtgatagactggattaagaaaatgtggcacatatacaccatggaatactgtgcggccataaaaaaggatgagttcatgtccgttgtagggacatggatgaagctggaaaccatcattcacagcaaactatcccaagaacaaaaaatcaaacactgcgtgttctcactcatacgtgggaattgaacaatgagaacacttggacacaggaaggggaacatcacacaccgaggcctgttgtggggtggggggagggaaagatttaggagatatacctaatgtaaatgacgagttaatgggtgcagcacaccaacatggcatatgtatacatatgtaacaaacctgcatgttgtgcacatgtacactagaacttaaagtataatttcaaaaataaataagaaaaccttctggaaaagtttcatcattgtagatgccattaagaacattgacgattcatgggaggtggtcaaaatgtcaatattaacagaaatttggaaggcattgatttcagttctcagagataactttgagggcttcaggattttagtggaggaagttactgcagatgctggtgaaaatagcaggaagactagagttagaagtggggcctgaagatgtgactacatagatgcactctcacagtagaacttgaacatatgaggagttgattcttatggatgaacaaagaaagtggtttcttgagatggaatccacccctggtaaagatgtgtgaacgttgttgaaatgacaacaaaggatttaggatattacataatagggcagcagcagggtttgagaggattgactccaattgtgaaagaagttcctctgtgggtaaaatgctatcaaatatcattgcatgttagagagaaatctttcataaagtaagggtcaatcaatatggcaaactttattgtttcaagaaattgtcagaactacctcaaccttcagcaacaaccctctgatcagttagcagccaacaacagaggcaaaacctacaccagcagaaggattacaagttgctgaaggctcagataatcattagcatttttagcaataaagcattttaaagtcaaagtatgtttgtcgcttttttagacataatggtattgcacacttaatagactacagtatagtgtaaacataatttgtatatgcactaggaaaccaaaaaaattcatgtgactccctttattttagtattcaggaacctaacttacaatatctctgagctatgcctgtacagaaaaactggatatatagaagatagtttcagaaattattcagaaaaggaagcttatcattagaaacacacgagtcttattcagatttactgcagatattacatgcctattcaagtataaatatgtttacttcgttaaattggcccacgcaattatgtcttttagattaataattatgtttgttttgtggctgggagaggtggctcatgcctggaatcccagtacattggaaggccaagtttgagaccagcgtgggcaaagtggcaaaaccccgtctctacaaaaaatacaaaaattagctgggtgtgggggcttgcagctgtagtctcagctacccaggaggctgaggtaggaggctctctggagcccaggaggtggaggttgcggggagcagatatagtgccgctgtactccagcctgggtgatagagaagaccctgtctcaaaataataataacaataataaaattatgtttgttttgtgaaaacatttttgcagttatcaggcatcttacattgattggctacatatattatagattgttttttttttttttttttgagacggagtctcgctctgtcgcctaggctggagtgcagtggcctgatcttagctcactgcaagctctgcctcccgggttcacgccattctcctgcctcagcctcccgattagctgggactgcaggcgcctgctaccatgcctggctaatttttttgtatttttaagtggaggcaggatttcaccatgttagccaggatggtctcgatctcctgacttcgtgatctgccctcctcggcctcccaaagtgctgggattacaggcgtgagccaccgtgcccggccatagattcttaatgtagggcatatgtgtgtgtttcagaggctctatgaaagccctgcattattaatatgcaaaatttggcataggattctttttctgggatgaaggttcatcagattatcaaaagaatttcttggaaatacttagtctcaattattttgtaattaaagaacaactataaatattttaattctgtggggaggaaaatatgatttttaatgtaagttagactaaacaacaggttgcttgaattttctctctgtagttgttgttctgatattatgtagacaaaggctaagtcctttaattatgtctaaattaatttacaatacatgaaattcacccacacttgttttatttatctctccatggaaacagcatgctttgagctgctactaaatatttcatatgcaggctatttatacttttatatttaaggatatattctttagactctattatttcatttaaactgtttctggaaatgcagtaaagtttaatattctttttaaaatgcattttaaatgagtcagcttttcattgtatggattgatttccttgccatcattcactatcgtgttttttgtttggttgtttcctaatgttatttcttaatatcttcctcttgcaaaaatttctcactttgggggcctcattacaaagtattttctatgtacatgttccaccagattttaaaaattttaatttttaaaggtataatttacatacagtcaagaacccaaatcttaaatatgtggcttaataacattttaatagttttcatgttttcgagtagttttaggttcacagcaaaattgagtggaaggtacagagatgtcccatataccttctgtctcttcaacaggcatagccttctattatcaacattctctaccagagtgatacatttgttacaattcattaacctacactgatacatcattatagtccaaaattcatagtttaaattagagttcacttttagtgttgtgtaatctatgggtttggataaatgtataatgacatgtccaccattatagtatcatatggaatattttcactgccataataatcctctgtgctctgtctattcctccttccctaccccttaaccccagatagcagctattgacctttttactgtctccatatttttgttttttccagaatgttatatagttggactcacacagtatgtaaccttttcaaattgagttctttcatttaattatgcacatttaatttttctgcttatcttttcatggcttgatagcttgatagcccatttctttttagcactgaataaaatttcattgcctgcatgttcagagtgtatttactcacctatagaaggacatcttggttgctttgagttttggcaattatgaataaacctgctataaacatccattgtgcaggtttttgtgtgcatacatgttttcaacctatttgggtaaataccaagaagcacaattgctgtatcatatggtaagagtatgtttagctttgtaagaaactgccaaactgtcttccaaaatggctgtactgcttttcatttccaatagcaatgaatgaaagttcccactgctgcctacccttgtcagcatttgatgttgtcagtgttctggattttggccattctcataggtgtgtagtggtatctcattgttttaatctgcatttttccctgatgccatatgatgtggaacatatattcctatagttatttgacatctgtgtatcttctttggtgaggtattttttaagatatttgttctgttttttaattgggttgtttccctaatattgagttttaagggttatttgtctattttggataataaccagatatgtattttgcaaatattttctcccagtctgtggcttgtcttttcattctctttatattgttttctgtggagcatagatttttaattttaatgaagtcaagttcatcaatttttttaaatacatcatgcctttgtcatcttatctgaaaagtcattgccaaactcaagttgttctatattatcttgtatgttatcttccaggaattttatagttttgcatttaacatttggtctgtgatccattttgcattttttgtgaaagatatgaggtctgtatctagattcaatttttttttttgtaattcgatgtccagttgttctagcaccatttgttgaaaaaaggtatctttttttcattgcattgcttttgctcctttgtcaaagatcagttttactatatatatatatttgtagttctatttctggggtctttattctgttctattgatcaatttgtctattcttttgcaaataccactctattttgatttctgtggttctataataagtcttgaggttgggtaatgtcagtcctccaactttatttttctccttcaatatcgtgttgtatatttcaagtattttgcctacttcatgtaaacgtaagaatcagtttgttgatattcccaaaatagtttgctgggattttaacagagatttcattgaatctatagagcaagtggggaagaactaatattgtgataatattgtatctttctatttatgaacatagactctctctccacttatgtagtttttctttaatttctttcatcagagttttgttattttcttcataatgatcttgtacatattttttaggtctataagtattttattttggggtatgctaatgtaaatgtattgtatttttaattttaaattttacttgttcagtgctgttatacagaaaagtaatgggattttgtatattaaccctatacactgaaattttgctataatcattttattagtctcaggaatttttttgttggttcttttgaattttctacatagatattcatgtgatctctgaacagagacagttttatttcatcctttccaatcactacacctttttgtcctagttcatttgttctgtgataacacagtcttgataatttatgaagaacagaaatttatttctcacactttggaggctgggaaattcaagatcaagacagtggcaggattggtgtctggcgagggatgctctctgctttcagtatggtgcttccaatattcctctttgagaggagaagaatgctgcatcctcatgtggcagaagggatggaatagcaagagagcacttttttcacccttgagcccttttataaggatgctaatcccattcatgagagtggattgtgagataatcacttccaaaggccacacttcttaatactgttgcattggagattatgtttcaacatgtattttggagaggaccacattattcaaaccatagtaattttatttccctttattattttattagctaggacttcagtacaatatttaaaaggagtagtgagatggtacattcttgccttgctcctcatcttagtgggaaagctggttttttaccattaagaataatgttagctgtagagattttgtagatattctttattaagttgatgaagttccccttcattactagtttactgagagatttaattgacgttggattttgtcagatgctttttatgcatctgttgatatgatcatgtgatgtttttcttctttagcctattgatgtgatggattacattaatttatttttaaatattaaactagacttgcatgcttgagaaaaatactacttggttgtggtgtatacttacatttatacattcttggatttgatttgtgaatatatacgtatatgtgtgtatatatatctgtatatatgtatactatatatatatattttttttttttttgagacagagtcttgctctgtcgcccaggctggagtggcacgatcttggctcactgaaaccttcgccttccaggttcaagcgattctcctgcctcctgagtagctgggattataggcccaagccaccatacccggcttgatttgtgaatctattttgttaataatttttgcatttatgttataagatatatcagtctgtcgttttcttttcttgtaatgtctttgtctggttttgttattagggtgatactggcctcagaatgagttaggaagttgtattagtccattctcatgctgctaagaaagacatacctgggactgggtaacttataaagaaaaagaggtttaatgaactcacagttccacatggctggggaggcctcacaatcatggcagaaggtgaagcaggaacaaaggtatgtcttacatggcagctggcaagagagcatgtgcggaggaactgccctttataaagccatcagatcttgtaagacttactatcatgagaacggcatggaaaaaacctgcccccatgattcatttacctcccatcaggtcccttccttgacacatggggattatgggagctataattcaagataagatttggtggggacacagccaaaccatatcacaagtattctcatcacttctatattatgggaaagatttagaaaaatggcatggtataatttatttcttaaatgtttggtagaattcactagtgaactcatctggcctgggtcatttctgttttggaaagttattgattattgattaaatttatttaatagatatagagctttacagattatcttttgtgtgagattcagcagattgtgtctttaaggaattgatccattttatctaggttatcaaatttgtgggcatagagtatttctttgttattcttgtaatgtccagagaatgcatagtgatgtctccttgtttattttggtcttattaatttgtatcccttctctttttttcttagttagcctggctagaggcttattagttttattaaccttttcaaagaaccacgttttgttttcattgacttttctctgtttatttcctgttttcaatttcataggtttctattctgactttatttcttttctcaggccgactttggatttaattttttcttctttttgtagctttctaaagtgaaagcttaggtaattgatcttagatcttttctccttatatatgcattcagtggtgttactctctttgcactctttcactgaatcacaaattttcctaagttgtgtacttatttttatttagtcaaaaatatttttatatttttattcagatttcttttttgacataggttattcaagtgtttggggattttttagctacctttctgttactgactcataatttaaccccatttcaagacattgtaagacttctagtcttttgaatttgttaaagtgtgttttatggcccagattgtggtttagcttggtgaacattccatgtgaacttgagaataatgtgtattctgcttttgttggattaagtagcctttagatatgcattatatccagttgattgatgttgttgaattcaactgtattcttactgatgttctgcgtgttagatctgcccaattctggtacagtggtgttgaagtctccagctgtaatagtggattcctctatttctccctaaacttttatcagtttttgtctcatgtgttttgacactctgttgttcggcacatacacattaaggattgttatgtctttctggaaaattgacccctttatcattatgtaatgaccctcttcatccctgataactttacttactctgtttcttgacctgttgggtatttctcttcctccatgcggaaggctagagttgattggagttgggtatttcctttcacctgggtcagttaggctctgataaaatcctagtaggataggcagtgattacatatattctcctgagggcagacatttttgagaagtacaaaatgatctggtgtatttctaaatgggtcttttcccccttcccttgtgggaatcataagggaattttcctctagtattcactgtgagaagctagtagagctccatgaagtaataatcacaaaagtgtgcagtctccgggatgactgggtgcccctggagtttttagtctctcagacttgtcgacaccgagcctccagtaatttgtaaactgctgttcaggtttctctactgtggcactggttcccaaggacgtttttgcttgtgggctgctgctccagtaagtcattattctctgtatctgcctgtctttctctccagttttaggggcagtggtttgcccagtgacatcatttctcttatagatttaagaagagttgctaatttttcagtttattctgctttttacttattgttaggatgaagtggtgacttccaagtttcttacatgtgggaccagaaactggaggccaccaccatatattttaaaattatatagttatgttgtaccctataattttatatttcagtataggtggtatatatatatttggcctatgtgtgacagaaataagaaacaaacagaatttattggattatttatttccccaatcctttaagtttttttttaaagactaaattattttctctttccttccatgaaattttgtacattttgatttcagcaagatgcctttaaccaacatgtttttgattcagtggttacaaatagatatgtgctacttgcctttaaagtcaagttaaagtcctttctggcttagccaaaaattatgtcatatatatgacgctagttccctgggactgaggagatgtttaggatgatcttgtaagatatttttctcgttttgatttgcacacttgaaatatcaaaaagaacagatacctttaaagctccccttaaatattgttcctgacattttttgggaagaagattttcctatgtgaacatctttccttgcaggaaacttttttttgttgttgttattgctaatgttgccttataaagaaatacatccgccccacttttctagtctctaaacacatttaatggactggtgaactaaatacaattatttaataatcacttctaggaataattacttttcagtgttggaaaggactttaagaattctcttgtatgtaaataatggctttaaccaagtttgctgaatacaagtttcttgcaaaccccaaacattttctacacattggataattttcatgccaagacccccatcacacaatatatttttacaatgacttttaaagcattctttactacaaggaggaaataaagaaatttttgaacatcatttactaaaatcaggaaaaacgatacacaactattttttggaacattctttgttgaaggaggaagggcaataaataaacttggaaactcctgtgggtgcgacgctagggctagctaacttgatataagttgtaagaacaaaggtaggaagattgacacatttcaggactgggacactggcaagtttttgggaaagtaaacatatcaattaaaaaagaaaagtaacagttctgctataatttctggtcttagttgaaagtccagaaagcaagaaattattacaaaagttcaattataatctggctaggatgatgaccgcaaatatattacaggcccagaatatgagagaaagatctgaaaatgagagatagcattggtcaaagggaaatggccctaaatttatagttattatttactgtgtcaccatagacagctgtatatgctatgaacaaaccatttggaaaatggaataagcaacaataaataaataattttttaataaataattttaaaatgccatttacaatagcatcaactactgtctgggaaatacttaggatgccaatacctaaaataatagatgttcaagtcctctataccccaaattgcaaaattttgcagagaaattaaaggagacttaagtatatattgaaatatactatgttcatggatttaaaaactgtcattgagatgctatttctctacccactgatacataactccagtgcatcccaataaaaattcagctgcatttttgtagtcgctgctgtctttagaatttaaatgagaatacaaaatgcttaggttagctaagacatttcttcaagaagagaacaatgttagagaacaagcaagacccaagatttactataaactggcagtaaataacacagtatggtattggcataataactgatagattagtggaacagaatagaaagttcggaaataggttcaaatatatattgatttttgacaaaggcaccaaagcaattcaataaagaatagaagacctttacattaaatagtgttgcagtaactgagtatttatatggaaaaacaaacttgaacctatctcatataaataaacaaaaattaattcaagatggatcatagacataaatacagcttctagagcaaatcacaaaatatcttcaggatcttgaaaaaagcaagacatttttaacagaatatagtaggcacaaacaataacagaaaacaattagaaattaaatttcatcaaaattaaatattttcttcatcaaaaggcagaaagtgaaaaggcaatccacagacagggagcaaatatttgcaataaatattcctgacaatagacttgtatctagagtacataaagaattactataaatcaataaaaagacaattcagtttaaataaaagcaaaggcttgatcagctattttttaataaatggacaaaaaagtatagaaaaagatgcttacattatcattatcaaaaaatgtaaattaaaaccacagtgacataccactaccaatggctcacattggaaagactgacaatactaaatatcagcaaggataaggagcaaattgaactctcttactttgctggtggaaatgtaactggtataaccattttgcacaactatttggcaatcactagtaatgttaatcatacttctaccctatgacctaacaatttcattaatgggaatatactgaagggaaataggtaaaatgctcataaaaagatttgcacacaaatatttctaacagctttatgaataacttcccaaaccaggaaaccacccaattgctctttaatagggtataacattataatgttctctatttatattttgtcatcattgcaatgtggtggaacttcagtagtttctctaggcttaaacttaaagagtcatcttgaatagaagtctaatgttttttaaatgatattttctgcagtgtttatgcagtacagtgagctgtgaagattgcagttatatccgaggtggttgtgtgtaatcaactagatgaaattttgtgtaaaaattgattggatagcataatctcctagtggttctattctgtggccagcaggaaaaattttggtaagtgtggcaggttaaggtcatgaaccgtcacatacaggaagaagtcagaatcgtgaatttcccaaatagtgagtacagaaggcatgtagcaatggccatttactgagccttcttgactagaacttaagtttcaggtggaagaagtaaagtcagtcaaagagccagaaccagcatcctgaagagtatcagcagaacatcaaggaagggttgtgctactgttttcctcttgatattattataggtagtgagattgtgaagcataagaaaggagaagttacttaaattagctagaacaggttgctggttatgcaattacaagtgcacttaagactagagaaacgtttactgaagagttgggttttgatgaagtacccttatagcatatagataataaattcacagattttgaacttaaagcaaggaaaaacatacagtagcagatttaacgggcaatgaagataagataacaatttattactacttaactggaatacttaaaatcagaagaaagggcagcatgggccaggtgaagtgacaaattaggtgaggatcttcaaatacactatacagagatgcatcattttagtaatgtgaaggtctgagaggttaagagatttattaattatataaggtggactcttagtacagaagtttttgcaaacttgcaattttggtaattgcttttctattataaataaaaatcagcattaaagaaccctctgaaatacattaagttgcgtaatgccaaaaattaatatgctttatcacactgaaggaccttggttgtaatataggcttcagtttctttagacacctttttggcaggtatgtaaagccatatgcacaatatgtagttgactgatactgtgaaatgactggaattttattggacagtgggaggtgaagcagccaagacatataatagttttgcagacatctcaagagatttcaaaatgaagaaaaaacccaaaagttttagcacttgtgtaaaataaaatcattttttatctttgctctgaaatttcttcaggtttcaaaggtcctgtaataaatgtgttagcactggatttttccttgctgtggaagtgagctgtgagacaattgaaatagattttggaatgcttgagacgtgaggggttggatttaagcagatctgagataggaagtcaggattctctatggtctcttcagaagtttatgagactctgttatgtggtcatttattttctgtcatttgacttttgtctgatttgtcttgaagcttctatctccacaacttttctgggcacttttttaaacacacaggaacttaccttggagaacattttttaaaaatataccaaaaatactgtgtctaaacttctgagaatgtataatgtgattgtcttctgaaaagtaggagttaaagtacgtttttatccttgggaatattgttaaatgactaatagaaagtggaaacctggaggcatggcaacgaaaagtcatttaaaggaaccagtttttatttatgaaatgcttactatgttaagagatacagtgcattgtaatttttttaatctaatggacaatttttaaggttttttttttctaaatagagaataccggattaacctataaccttctaagttgtacctttgaagaggcttttcttgctatgtcttgaatagccattttgtattatctatagctctccctggtcttcctgtcctcaagaagtgttaaaataatttgttgttctaaggtagagaatgggccaaagtaggaggatacatcaagatgtctaattggaaaggaaatcagattgcttttccagtgatcaaaggaagtatagcagtggagcaatgaacttttaaaaatgattcttatgggacaaggaaaccattgttgtaattttgttattcagcaaccagaaatgatgaattagatgtttactaaatcattgcacttattgtggtacaaacgcctgttggctataaaggatagctcttaaaagaaaccagaaagcaagggaaacaaaaacaatcgtgtcactttcccagcagcatgtgatgatgaatttctcattcaaaccctgtgaaataaatagcttgctcattcaaaatcatttttttttctttcttttttgagatggcatcttgctttgtcgcccaggctggagtgcagtggagtgatctcggctcactgcaagctccgcctcctgggttcacgccattctcttgcctcagcctcctgagtagctgggactacaggcacccgccaccacgcccggctaatttttttttttttgtatttttagtagagagggggtttcacggtgttagccaggatggtctcgatctcctgacctcatgatccacccgccttggcctgccaaagtgctgggattacaggcgtgagccaccgtgcccggcctcaaaatcatttttggttctcagcatccttaaaatacttttttagacaagttacccagagaatcatctgtgccctgtgtaggcacaggtgattgttcattcccccaacccccactcttcagagagagactttgtcaggcaagttttgaagtgatttatccaggatcactgtggtaataaccttcaaagactggtaaagaactaggtaggactctagccctactggccaaagatgaagttgacattataaattgcaaccgttgacaatctctgatgtaataatgggaatataaggctggaattaattctgattcaagagacctaattccctggcttttaatcagtgtataccactgaatatctctacctaccttagtttttatgccggtcatttaacctaagcatcttcatctctgtcaaaggctcctatttcttctcccagtagcagctgccgttgtaaacaaataattaagttgaaccagttgtaatgattgttgggtagccatgatacaacataagggtggcaggaataagggactcaatagtgtgactcagagtcattgaagtgattggcatgaggtctcagcagggctttggtggctggcaaaaagcatggagttggactggatgcctaagtgcagttttggtggagaacgaacagtgcaagaagttactttatggataaaaaagatgactttcagattttgagatttaatatatctttgtccctggataacattatctaaatttagaggccatgtaagtggagaaaggaagataaatgaagtcaagaaactctgacaacagggtgaatagggcagattgccccaaactaattaactcatcagtcagttactgaacaccatatacatggtgtaaaggatcaaataaattgaaaaacatactatttatgtgctgcaggattgggtggtggcaggttttgaaaaactgatgactaatatactcgatgattataatagaaatagtgcctgctgcttggtaggtacttagatttttatcaaaagaataaatttatgcatgaaatcgtaagaaggggcaacaagcagatgcatgtggaagagtgtcatggaaagacactcagaggagataagatttgagttgaacttgaaaggatagttagccatcagcaaggtagatataggggctggagtgaggaatttgaagcaaaagagatatgcctctctgtacaaaggcagagatgcagggtgaggctggagtacaggatgcatgcagaggaggaataaaagtgcgcccttagcaacccagaattattatttggactttgtcctgaaggaaatagaaagccattggaggactctaagatggactgtgataagatcaaatttagaaatatgatttctggtgactatctttttgacagtttagagattttgaagagggtaatactgtgggccttttggagtattccacgttgaaagtgtctgtcctactagacagttgaatagtcatggtcttttattttgtttttgttttatttcaaattaaacatgaacaaatttatatttcatatagtataaatatttgtatatatttatgtttataaacagttgtacagatcattgtagataacataagcacacactttgtatatgtgtatacaaatacatatacaaatatcatatacatatgtggtatccagataggatgaggtttgtgcatgagtcactgaagacccaaaataacagaagtttgtatttctttcatgagaaagaaatatgtaggcagtctagagttgttatttgtgtttcagatatctagacaccttttatcattttgttctgcttcttatagcctgtaacttttccccattgcccaggatgtctgcttgagtttcagcattatgtatgcattccaattaacaggaaggaggaaaggatggaagactttaaggacacttttactataaagacacattcaacatgacattttaaattatattccattggtcagaatttagccctagagccttgcttagctataagaggggctataaaatattatcctttctggatggcagtgtacccacttaatagtggtggctctcttgtgatcaagaaggggaagaaggaatacagcatgagaatgaactgtgtatgccagatacacgtagttatcctccttttccccagtaattcaatgcagaaaatctctctctctttttctctttctttgtctctctctgtatgtgtagggggatatatgtgtgtgagcatatttttagaagttcttccaatagggggaatgtacaatcaacgcacattttgtgggcaataataacattttataagcacaagtgttttttgaaatgcttgtgtttatgtaattggcttaatgtatactacatgtgatgattgtaataagttgcatttgtatagagctttaaaaacatttacaaaagtacattcacacttgttatctcatataatctatataacacttttaaggtaaataggatggtgtactatccctattttatatgtggggaaatggaattatgtggttcgatattgaaactaggactggtattcactgacccctactttagggttagtaatggaaggcaataatagtatggattttcgagaacagaggataattagaaaataatttgtattttaatttgaatgaatgtatgctagtggacatgaattcttgtcatttgtttgataaattagcattcgagaattttttcccacccacctgagcagtggtatcttggccatggtcagagcgtcccatgctgttttctcctcctaataggacagatcaattgtgtggtgctgctcagttaatgtaagattgatggataaatttactcatcaatcatgtatttccctgcaattgtaacatgcaaaagttgtctacaagttaattgttttctgacacattcattgtacaaaataatcagagaatcccactatctttttctgcaatattgctttgtaaaaacagagccctggtaaatgttatcaccataaaggcaaaatgaagcactttcaacacctgactgaaatcatggtgttttgagctggtgacgtacattgctcaaaaggacatagtttataatttctactccagggggcattcagattagtacaaagtacttttagcctcttatcgttgggagtaaattttctgaaggtacatttatcttaagaatagcaaagaaaaaagagagctattgagtggctgactaggccgggaattgagctacctcttttgaaaagactgaatttttacttagaaacccaagcaatattgttcaaattttaaactctcatttgggccagaatgaaactttgaccactaatgaagggttaaaacaaggtactctgatatgaagtgtctttttttgtttttaaatgggttaaaaattataaaaactagaagtatagcttcttgctaacattcattacctccagggacatttttcagtccatcaaacttctccattcagtaataccattattgaagactctctacttcttgaaataccttctttctttggtttctgtaactttactctttccttttctctttctaaccccttttcctgtgttttcttagtttactttgcaggcttgtgttcatccacccagccttccacgtggcttgttcccagcccttcctttcctctgtacacctctcaaacttcctagcattcttcccatgctctctctcactctcagagacattgtacgtgctattttcgctgtctgaagtatccttcccttgaatatttaccggttaacttctattcttctaatgtctaatgtaacatacaaacgttgtctacaagttaattggtttttgacatattcactgtgcaagataatcagagaattccactgtctttgttctgcaatattactttgtaaaaacagagccctggtaaatgttatcaccataaaggcaaaatgaagcactttctttctttcttcctttcttttttttgttatactccaagttctagggtacatgtgcagaacgtgcaggtctgttacatacgtatacatgtgccatgttggtgtgctgcacctgttaactcgtcatttatattaggtgtatctcctaatggtatccctcccccttccccatgacaggccctggtgtgtgatgttcccaccctgtgtccaagtgttctcattgttcagttcccacctatgagtgagaacatgtggtgtttcgttttctgtccttgcgatagtttgctgagaatgatggtttccaacttcatccatgtccctacaaaggacatgaactcatccttttttatggctgcgtagtattccatggtgtatgtgtgccacactttcaacacctgactcaaatcatgatgttttgggctggtgacgtacattgctcaagaggacataatttatattttctaccccagtgggcattcaaattaatacaaagtacttttagcctcttatctttgagagtaaattttctgaaggtatatttgtgttaagaatagcatatacaagcctaaattttattattagatttaaattagacctaaatgtaattatcatttgttcagagaagccttacctgaattctgatttataaaaattgcctggtatatctctcatagcatcctctagctcttcttcctacacattacatagtaagctccatggggacggaaaccattttgcttttctaacaacttaatccccagtgtccagtacaatgttcatcacacactaagtgcatgatatttttgaatgaatgaatgaatgaatgaatacattatcatagatacaaataacacattatgaaaatactgttgtgtaaggtatacacacatagataaaggcatccaggagtttccttatttattggctgaactgagcatcaaagcatagatgaaaaatgagagatcaatgtcaaatcatcaggttttcaggttgggatgtaggctttgttcttagtgttgtgggacttaaaagatgcaattgcgggcagaggaaagaatgaatttaagtggttcagtagtgttattttaattcccttcaataataattcactttctctagataccttcaatgtgtaatatcaaaggcaaatataatttttatttctctaaacacaggctcgtatgtagaagatgacatagagatattggaacacctgctacttaactaaatgaccctcaaaattcaattttcatgtgtttttctgatgagaatctgaatgatgggatgaggaattggggaacttctaacatgggttggttttatagtttcagaatgagaactgataaaatcttaatatcacgtctctaattattatgtaagttgactatattcttatatttcactaccaaatatactactcctttcccactggggacaaattttcttcttttggggacacattttgatggcaataagtgcatatttttgacatgtgtaactttctgtgaaataatgctggggaaattacagataactgttaaatgagggtcaacagtcatgccaagccctatatccagatagcttctcttatggattagatttataaagtcctgggagagtgctttgtgtctgtattcactagacattttaaatcttctaatacatgttttatcttactatagccattagaaaacggttcatgattgttcaaactttttttcctctttcttctctctttcaccctccaccccagttttgagctacttgttataaatcttgactccattaaattcttacaagaacattttggaagctgctgctattggggaaaaggtgcacagttagcaatcacctgaataattagattcatgtaaaattccattttgcataatgtaagtcctagcctactcctactgtgtctttcctttagaatctccacatctctacaaattatgtaataacctttagtaaatgctttggccacttagataatggtgatgcatctataaacctcccatctccagatgttatgtactgaaatgtagtgtaaaaaaactgagtcaatatttatttttcttcagcaaaatatataaaatgtgaagaaatgagaaaagagaaggaaggaaggaaggaaggagaagaaaagaaaagaaagagaatgagagcgctttttgaaaatttccagtggagaaaaaattactcatcatgctagaagccttgtaattgatagcccattgatagtctgggaatattctgaaggatttttgattgatactttttaaaaatattacgataatatttgtatcattgcctagtcatttatgtatgaattctataataatatccctttattagtacgcaacatttcagaaatcctataaaactaagtgtgtgttcatgcagagaacatttaaatcagtaaaatccatacatcaaattaatctggacaagtctttctaattggttgcaattggcatttactgtagagctttctttacattctcattttatttactgttgaaagtactgtggattacctctggggagaagaggaagaatgtagcataggtgacattttggtaacattttactgctttaggtggacagtcggtaaattggtattcattttcttattctttttcacttgtaataaatttaaaataagaatacaccataaggcagactttcatatgtaataaatttttaatgaggatactacaccataaggcagacttaatagtgactagttttgtgaatttgcaagcaagttgtatactcattctggatcttgaagaacttttggtaaaaaataaaaaacaaaaatagtaaatataataattcatgaagtcagagctttactgagttatggccatcttttgaggctactttagttctatgaccaatttagattatttgtaattcattcatcctttgaacatttggagtgtggctaatgtttatatgcaattaaccctatatgtaacattgcttcatatttatataaagttattataggacggacttccaacatttaaaagggatgtgccaattggaagtgaaagtattagttgttcactgtctgaacacaatccaaaccactggacaattaggttaattcagagaaaatagaatcataggatgctagagctggaaggaacctcagagataatttaatttacccctttcaattataaataggaaattattacagtccacagaagctttagtcctgcagttagttaatggaagagctagcactaaaactcaaatttcagagcttcctctctgcttcctttctactgtattggtatttcccaaattgtcatttccaaaattgttcatgtgagtgaaaccaaaacaaacaatcacaacaaacaacaataataaaaccaggattttgtggcacagtaactttttgaaatattgcatcttgtatatcccttgtggattcacaatgcactttaatatggtaaaggctctgagaaaccctacagtaaagaaatctatgtaaccatttaatccactcttccccaaattttttgacaactgaacctcttctatgctaaacaaccagtacgttttaagaaagaaagtttggataatactatgaaattagattgtttattgttagcatgcaacttgattatatatgccatgccaaacccctgttgatttcaatagggatagcactgtgttggataaagaagaggataaaggagaaacttggatccagtgaatgagacgtggggtttattcaggggacttacatacagtgtggtccagcggcagtgggctggacaggagaaccactacagtttgtaaaaaaacatgcagtcttcacttagcaccctccccttggcaaccttcacgtggcaaccatcatttaaccccaaacaaaaggccttaatctccctgtatgggcttgcattccacaggatgggtcaggggtttagaggttccttatagataaggaatgaatcttcaagttggctgttcctggatttcttagctcagaactctgaacacacattcttcttaggccatggtgtcattctgagggcatgcttaagttattgttgtcaggtgcatctgccatacagggtcattctcagggtatgcttaagttattgctgtcaagcgcactggccatacaggagcattctcagggtatgctgaagttaatgctgtcaggtgcattgaccatacagggtcattctaagggtatggttaagtcgtcattgctgtcaggtgcatctgccatacaatataacgatcaatttttaaaattagattaactgatgacagcatatagctctaccttaatggacgtagacagttgctcaatagagaggtcagtatcccataagtgctttcaaatcttttcatttcatggctcagtgaagggactctggagagagaacaaggttctagctaatgaaaactgattggagggcatactgatgaaaatggtacttagtaattaataatggaaatacaggtattaggcaatggcaatggaaacagaggaaagagagaagagagtcagagccatttcagagggatgggttgttttaggcccatctctttctcactggaacaaacctcaaaccaagtaaaaataccagaaagtgatacaagaaagacgattagtgtgaggtaagtacaaaggaaggaaaaacatcaaacatggacatattaaagataaatggggcaatatgccatgtcctggaggttatttttgaatcacccaacaaacttaactcttccatatctaaactcctaaagcttttctttcttgactctaattttacttaccctgttctggattttcctttagttttttgagtacatgttttatcactcccaagatattattctagaggacaaggacagtagcttgttttactaagttccacaggtactgggcaattactttgtatgaatcacgccatcgatgaatgtttgctgaataaacacacataggacaaaagcatgcataagtgtgtaactacagtagagtatgtgaagcattagctctgatgatcccttctctcaaaaggtttagagtgtacttcagacaattaacgcactaaaaaagactgttctggtgtgaaacccttgatataggacatatccattacaaggaataggtcatagaagcctttgtagagaaaatagtgttgaacattaacagtatttattgaaagcaatgttggtagttatattagtcctgttgtaacgaaattatcacaaacttaatgtcttaaaacatcacaaattatcttattgttctgtaggtcagaagtctgaaatgagttttacaaagccagaattaaggaattggcagagctgcattacttctggaagctccagggaaaaatccatttgcttcccctttccaacttcttcttttttttttttttttttaacttttaagttgaaaggtacacgtgcaggtttgctatataggtaaactcatatcatgggggatttgttgtacagattattttcttgaccatgtattaggcctagtacccattagttatttttccagatcctctccctcttcccaccttctaccctccagtaggccccagtgtttggtgttcccatctatgtttccatgtgttttgatcttttggctcccacttaaaagtgagaacatgcagtatttgattttctgttcctgcattagtttgttaagtataatgacctccaggtccatctgtgttcctgcaaaggacaagatctcattcttttttatggttatatggtattctatggtatatatgtaccatattttctttatccagtctaccattgatgggcatttaggttggttctatttgctactatgaatagtgaggaaatgaacatagatgttccttgtgtccttatgacagaacaatttgtattcctttgggtatacatacaatgatgagatggctaggtcgaatggttatttatgtttttaggtctttgaggaatcgccacattgttttccacaatggttgaactgatttacactcccactcacagtgtataagtgcttttattcttcataaccgtgccagcacctgttattttttgactttttaataatagccattcttatttgtgtgagatgatatttcattgtggttttgatttgcatttctttaatgatcagtaattttgagttttttttcatatattgttagctgcttgtataccttttttgaaaagtgtctgtttatgtcctttgtccactttttaatgggtttgtttgggtttttctttcttgtaagtttgtttaagtttgttatagatgctgcatgttagacctttgtcagattcgtactttgcaaaaattttctctcattctgtagtttgtctgtttactctgttgatagtttcttttgatgtgaagaagctcttcagtgtaattatatcccatttgtcaatttttgcttttgttgaaattgcttttgacatcttcaacatgaaacctttgtccattcctgtgtccagaatggtattacctcaattatcttccagggtttttatggttttgggttttacatttaagcctttaatctatcttgagttaatttttgtatgtggtgtaaggaagggtccagtttcagtcttctgtgtatgggtagccagttatcccagtaccagctgttgaactacttgtctttgtcaccttggttgaaggtcagatagtcataggtgtatggccttatttctgggctctctattttgttccgttggtctacgtgtctgtttttgtaccagcaccatgctgttttggttactgtagccctatagtatagtttgaagtcaggtagcattatgcctgctgccttggtatttttgcttagtcctggccagagaaatcaggcaagagagagaaataaagggcatccaaataggaagaggggaagtgaaactatccctgtttgcagatgacttgatcctatacctagaaaaccctgtagtcgcagccccaaagctccttatgatgataagcaggttcacaaagtctcaggatacaaaatcaacattcaaaaatcactagcatttctgtacaacagtagtcaagctgaaagccaaatcaggaaccctttttcaacttctaaaggctgcttgtgtcctttgcttacggccctttactgcatcttcaaagtgcatcactataacctttgcttcgttcttataaggaccctgtgatttttactgggcccagcagaataatgtagaataattgctccatctcaagatctttgacttaattacatctgcaaagtctcttttgtcatgtcagataacagattcacagattctgggaattaaagactgggatatcttttggggaccattattctttctaccacagtggaaaaccagcatcagcaaagttacggaagttgaaataagcatggagtgtatagccgaataataaaaagatcaaaatgaaatgtaaagtatgtattaagaagtgtggcaaacaggattgctaagcaggctggtataagttacaaagccctttaaaactcaggacaggagatttagatttaatgcagttaatactagcgaacattccaagtttttaaagaagtggctactgttatgaaaatggtatttataggaggttggtcatgtatgatttgtaggagagcctggtggagagaaagtttgatggcagggagaatcgtaaatgtacagtcagatgtggtaccttgcatagttatttacgtatgttggatacaatgcatttctataaattgtttgactcaaaaattatatttttgaattaaagtagcaattattaatttttttacaattcacttattttatattgtatctgtttttggaccatagtgatggttgtcaattcataccttgtcagtcagtggtttttctttgcttcctcattgtctttccctctgtcttaacacctatttgctaatggctattctgaagggattcttctttttctcattcagagaaatcttatgtgttcttgtgaaagtaactttatgttaggaatggtaaattactttttttagatattgttatacattttcttctttaattattaaatttgtgatattagtgaattcttccaagggggaagatactgacatcagactgaatatttactttaagtacatcttaactggagcttttattgctttcacctggaaagggtcaacacttagttgaataaaaaggattcacctttttacttgtaatggaatatcaactgcaatgtggtttttgatggtccaaagaccatggtgtcctcattatatttaacgtcagagtaaagtgccacatttcctctggcaccagaatggaaaggactgcatgcataatagataaaaaaagcatagatataaaaaaagatataaaatatactatttttctgctggtgataggcaccttctccatcctttccctattgcaatacatgaattttgcccttctccaactctaattgatggtcatttagtatcagagtaatgaattctatagttggcctgtaacctgtggctggaacttttgctaggtcttgggagatgagacacccactctctactgaggtggataagctggtaaatcttaagtttgggactgctgagagtcaccattagagagagttttcttaacaatgaagtcagtgcagaggaaagcaaagcccataaaaaagagtctcagtgttggtgagatgatttgagccctggatccaaccatgatttaaactcaaatatttctgtttcttttggtttataagccagtatattttcttcattatttaagctgattttagttgttcatctatcagtttctgtcaagactccactcttgcacagtacacatacaaccagaactcttacttgggctccaaagtctcttcaaggtccctctgtggcatgtttgtcatggtgttgagttttccccttcagctgcctgactttgtatcttggcagaaggagtgagctagatttccttgctacctcctggtaatttgctgagtcatacaactctcttcaaatatgatactgttatagtagcattaatacagggattctaaaggaaaaatatttaattgccataatggggacaaaaacctggttgataaatcttttcatatttttcctatttatggaattagaggaatgaacacaagactgtcttcaatttatctattactataatggattatttctttatttcactagcaataaatgttgggggattcctggggtatttataaggagtaagagatagttttgctaaaagaatctttaaagattttattgaatgtgagatatccagtaaatgataggaatcagtcttgattctcatccataatttctgcttagggagaaactttaaccaagtttttttttaaaagattaaatattacaatatttttttccagtttttttttcttttagtggctctcctttcttatcaccccatataacctaagaggcagagagagtagttctgttgctaactcttgcagaagttgtgcccatttcttttttctggtttgctgagatttttatgccaataataaggtcggcattcttctttggaaaagaaagttgtctaaattctacgtataagtggcactatagaaatatttggaaaataacaatggcatactaaaattacttggaaacaacaaatgaacagagcagtcactatgcagtgtctgcaattcagaacaactctgctttgagactgtgacataagataggcagaaggagggaagattcaaaaattttcttcttggataaataattagatcaccttttaattattatcagactactgtatgattgctgattttgttcctcaatacttatatgtgctatttctttattaatcaattcctggactactcggtttctgtattcgatcctattctacaaaggccacagcctattggattttaaagagcccttaagtaaggttatctaacataacatccagctgtgtgggagagtgcactatataatatgtattcagcaaatattttttgattacatattaattagaagacattgtgctagacatcaaagataaataagatcaaaataccctcctgctgaaactctcaatgtaatgagatagaagaatggagtgaacaggctactaaaatattctataataaaggataacattgatttatatatcagaggttccagaaagctctaacatttgaattagtctttgaacatgaagcttagaaaacaaagagcacgctaggcagaggagacaatatgcaaaaacatggagacatggagagttcatagacaatttggataattattaacagattgacatgagatgaaactagtctattggtgaagaacgtattaagaaaagcttttgtagcaattgcaacaaaagccaaaattgacaaatgggatctaattaaactaaagagcttctgcacaacaaaagaaactatcatcagagtgaacgggcaacctacggaatgggagaaaatttttgcaatctacccatctgacaaaggtctaatatccagaatttacaaggaattaaacaaatttacaagaaaaaaatggacaaccccatgaaaaagtgggcaaaggatatgaacatacacttctcaaaaaaagacatgtacgtggccaagaaacatatgaaaaaagttcaacatcactgatcgtccgagaaatgcaaatcaaaaccacactgagataccatctcataccagtcaaaatggtgattgttaaaaactgaagaaacatttgatgctggtgaggctgtggagaaataggaatgcttttacactgtcattgagaatgtaaattggttcattcattgtggaagacagtatggtgattcctcaaggatctagaaccagaagtaccatttgacccagcaatcccactactgggtatatacccaaaggaatataaatcattctactataaagacacatgcacatgtatgtttattgcagcactatttataatagcaaaatcatggaaccatcccaaatgcccatcaatgatagaccggataaagaaaatgtggtacatatataccacggaatactatgcagccataaaaaggaatgagatcatgtcctttgcagggacatggatgaagctgcaagctatcattctcagcaaactaacacaggatcagaaaaccaaacactgcatttctcaaacataagtgggagttgaactgtgagaccacattgacacagggaggggaacaaaacacaccagggcctcttcgggggtgggaggcgaggggagggaacttcagaggacgggtcaatgggtgcagcaagccaccatggcacatgtatacctatgtaacaaatctgcacgttctgcacatgtgtagctgaatttaaagtaaaattttaaaaaagaaaaaaaagaacagcttttgtgttggtatgtgtgtgtgtgcacatgcaccattctgaagaattgggacttaaattggtcatccagacagcatgcttatatccagagttcacaaagcagcaattacacttttgagtactgctaattgccggctttttgcctatatattttgctgagatctttttctgatttgtattcactggtcctattctcaactccttaaattaaaattagtataaatctcttttatatgactatccctcagatatttaaaagtgtctgttccttatcttctagtcttcagaattaaagttccagtcattcaaactatttatcatgctcttcatagaacattccagcctcagaatgtagatagtctaataataagcaacttgactggtatgtagcaatgttgtgacctttctctggattctgcaagtaggaatatgagtgtcacttatgataatattagtatttttattgctataattgtcagctacattatatttgtatatattgactttaaaacccatagattagttttccaagactcactcctgtgttgattctgcccaatcctgtaatcgtgcagatgattcctatgttacaaggttttacatttattcttgttcaatttaattatagttaattttggtctagcataattgcctgtagagatacttaaatcttcattctctttctctgtgttatcaaccgcttatgttttttaatcctgtgtaacttagataaatatactttcattctaacttttgataaaaatgtagaatttcaaaggatacatgacaacatctacagcagagcactatagaacacacgtcaaggctggtaatatgcagaatttgcaatataaaatacttcagggatttgactaattagtttaattcacctaaaccagctaatattttcctgtctatactcctaattcataatgagtctgttaaatatcttctaaatcaaagtacattacatctttgacattacccagatcaaatagtataataaccttaaagcaaatagaaatcgtgttaatgtgacataccttttcttttaatgcacatttgttgagtcccagaaatatgtccatttcattttccatgtgaatgtgactttatttggaaataagcttttggcagttataatcaaatgaccttaaggtgaggtcattattttaatacaatataactggtatccttgtaagaagagaagaaacacaaagacagatacacagggagaattccttgtgaccatggtggcagagatgggagtcacatgtctgaaagcatagggacagcaaggattgctgacaatactggaagttaagagagctgtatggaacagattcttcctaaagcctttagaaagagcatcaccctgtcaacaccttgatttttggacatctagcatccaaaactgtgagagaataaatgtttgttattttaagactgccagtttgtagaaaattaaaaaccttgacataacgctaatgtcgacatttcatttttaccccttttttgaaattagatcaaaatatactcatcttaattcttctggcagtaatttggttttctgtgtttctctgaagattactgaaggttgattaatcatcacattattaggatattttaatgttcctctaagtttatacaaattccaggtagtcagatgctcacttactccactgtgtactcatttaaaattgtttattagttgctaattatgcacttggaactaagctagacactggaaatatggacatggtccttggacttgagaagcttatcataataagccaatgaaaatatcactgtaatttagagcaacaagtgtaatgaaataggatacctgtagtcctaggagaaagcaagaatagggggaagaaacctgggaagttttccatagcactgaatttaaggttgagtgcaatatgatgtatggctttaggcgaaaccacatacatcaattaattaaaacaaaagaatgaaagaaccttgcatagcatggagatgggagagaagaagaagctttctggaaatctaggtaagtagatttgtttgcagtacagtcagtggcagggaagagagaaggctggaaaagttatccagagctgtttattgagagatcttggatttctttctgaaggtcatacgcagccattataataattcccacccctacaaactttagatgtgtagcaagctctttcaaaggaagggaaacaaacaagtaacaacaacaacaaaaacatacaaaataacttcttgttgatcccctgtatttacttaaattatttttatattaatgttaattggttatgttcaaacctaacaggaatttggaattcttgtacatataattcacatacaactataaaataaaatatatttataaactaaataccaaagaactcccacaaaactaatcaaattcaatttaacagtgttaaattatatgaatgtaaatgtttgctgaaactaagttgcacctgctatggtgtagtttttttatagatatattttttttattatactttaagttctagggtacatgtgcacaatgtatgggtttgttacgtatgtatacatgtgccatgttggtgtgcaacacccattaactcgtcatttacattagttatatctcctaatgctatccctcccccctccccccccctcacaagaggccctggtgtgtgatgttccccttcctgtgtccaagagttctcatttttcatttcccacctatgagtgagaacatgcggtgtttggtatttgtccttgcgatagtttcctgagaatgatggtttccagcttcatccacgtccctacaaaggacatgaactcatccttttttatggctgcatagtattccatggtgtatatgtaccacattttcttaatccactctatcattgttggacatttgggttggttccaagtctttgctgttgtgagtagtgctgcaataaacatacatgtgcatgtgtctttatagcagcatgatttatattcctttgggtatatacccagtaatgggatggctgggtcaaatggtatttctagctctagatccctgaggaatcgccacactgtcttccacaatggttgaactagtttacagtcccaccaacagtgtaaaatgttcctatttctccacatcctctccagcacctgttgctcctgactttttaatgattgccattctaactggcataagatgttatctcactgtggttatgatttgcatttctctgatggccagtgatgatgagcattttttcatgtgtctgttggctgcataaatgtcttcttttgagaagcgtctgttcatatcctttgccccttgttgatggggttgtttgtttttttcttgtaaatttgtttgagtactttgtagattctggatattcgccctttgtcagatgagcagattgcaaaaatgttctcccattctgtaggttgcctgttcactctgatggtagtttcttttgctgtgcagaagctctttagtttaattagatcccatttgtcaattttggcatttgttgccattgcttttggtgttttagacatgaagtccttgcccgtgcctatgtcctgaatggtattgcctaggttttcttctagggtttttatggttttaggtctaacatttaagtcttgaatccatcttgaattaattttcatataaggtgtaaagaagggatccagtttcagctttctacatatggctagccagttttcccagcaccgtttgttaaatagagaatccttttccccatttcttgtttttgtcaggtttgtcaaagatcagatagttgtagatgtgtggtattatttctgaggactctgttctgttccattggtctatatctctgttttggtaccagtaccatgctgttttggttactgtagccttgtagtatggtttgaagtcagatagcgtgatgcctccagctttgttcttttggcttaggattgacttggcaatgtgggctcttttttggttccatatgaactttaaagtagttttttccaattctgtgaagcaagtccttggtagcttgatgggcatggcattgaatctataaattaccttgggcagtagggccattttcatgatattgattcttcctatccatgagcatggaatgttcttccatttgtttgtgtcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttattggtgtgtaagcatgcttgtgatttttgcacattgattttgtatcctgagactttgctgaagttgcttatcagcttaaggagatttggggctgagacgatggggttttccagatatacaatcaagtcatctgcaaacagggacaatttgacttcctctttgcctaactgcattgcttattaggttgaatatgtgagacacacttttccttaattgtaaattatcattcaatgttatgactacttatcatttcacctactcaatcttgccttttctaggtaccggcatagctttatagctaccaaattttagattatgttccctaacctgggtttatgtagttttattcagtattttatcttgaacattatgaaaccgaagactacatactactaactcactttaggaatagagctttcagaatttacttttagtttgttctgcatatctgtcaccagaccagagggttttttgggggttggggtgtgtatttaaggtgggagaggcaattctcatataaattcaataataaatttggaacaaatgtcattccatatgcagattagtttataaataatcatgtgcttactagcactgagctaccatgccatggccactaaaaacctcttaattctgttccattcctcttttttcttttgtgtcctaaatattgatattctagtctttgatataaaatcaacgattcagtgatctgcaccaaaaattcatttggcctgttttattttgaaatttttaacttattcagaggagtctattaagcttgaattttgttcttaaagtgctataatggtccttagcattcatgctgtgtcgttgaacttggatttaatttatttcatcttatattaaatatgttataagatgctgattagatattttggatcttggatgaggatgtactaaaacttagccagtctaagtaaattttaattctagaggattctctacagactgaaaacttaagatggcttttcaactagtctcaactagaaaataattctgttctagcgtgtgctctgttttctcttcctaactggagagtctctattgctcatagtttgtattggtgtctgatacgtatgtctatctcctagacactgtggtgttttcagaatggtagaaaataagattgagattgtgacagcaggctgataaatatctttatgtctcttttatttccctgtgtagtgtttaacacataatatactttggacagtgttttaaaaataaattgtacatttttgtagaaaaccaactatctttataataaacatagatgattacctctctttgagaaccaccagatattttagcttcctaaaggagtgagtccagtagcactttatttttaattaactgacttattaattaattaatttgggggaaacttggtattatttgttgaaatgcatagatagtattctaaagaaagtttggttaatatttatacttaggggaaagcagtacctagggcttgtggaaatttggtgggcagctatgacctgtgctatcttttaaaatagatttttttttgtattagaaaaggttttactagtatcaactaatggcaacataattcattactgtaggttgttgctataaggtaagatcctcattgtctgcatttcagaaaagattctctctgtgttattccatggagcagcagatagcaattctaagacactgaggtacacaccacagatactgtgcattttaattgactaatttgcctcttcaccttttgaattacaaagatgaggagctattgaatgaatgctcaggctttagcaaactaagggagaaatgtcattattaccacagaccaaataaaaggtacaaaaatgctaactgaacatagaaggaccaacttgcagaatgaccttgggaactggcgattttcagtggctcatccgcattctcttccttgcatctgcctgagcacagaatagttcattctctctccaaatctctttcaatttactaaaatttgtctttagttgaatagcagcagcgacgtccacactgtctcaagtcatgcattgaagtcattaaatgacaaatatgcttccttaggaaatgttttgtgactcattagtctaacaggagaagcaccatttctctacttccctctctgtctcctaacctcccccttttcttcctcctgtcctcccttccttctttcattttttttttaattcaagaacttgaaattaaattagagataatccaatttaactatttcatttgaggaaacgaaggcccaaacaggttcattactgccagagccagaagtagctcctagatgttcctgatctagttctttttgcaccacatacactgcttctttataatatgcatactaaaataaaagcataagtgaatattataagccttaacacatatgtgttcagcatttactgtgtgcaaggtgctatgatagatgctgtggagtaaaccaaagagaaagacaatgtttattttctcaagaagtttacattctaacaaaggaaataatttccatatgcatttttatataattatatataaattatataataattgccatatgagttttgtttttaaatcctgggtagaaagaattcaagtctgggattatgtttctttttattattattattattatactttaagttctgggatgcatatgcacaatatgcaggtttattacataggtatacaggtgccatggtgttttgctgtacccaacaacctgtcatctacattaggtgtttctcctaatggtatccctcccctatcaccctcacccgctgacaggcaaggtgtgtgatgctcccctccctgtgtccatgtgttcttattgttcaactcccacttatgagtgagaacatgcggtgtttggttttctgttcctgtgttagtttcctgagagcgatggtttccagcttcatccatgtccctgcaaaggacatgaactcatccttttttatggcagcatagtattccatggtgtatatgtgccacatttcaaaagctagcagaagacaaaaaataactaagatcagagcagaactgaaggagatagagacacaaaaaacccttcaaaaaatcaatgaatccaggatctggttttttgaaaagattaacagactgctagtcagactaataaagaagaaaagagagaagaatcggacacaataaaaaatgataaaagagatatcactactgatcccagagaaatacaaactaccatcagagaatactataaacacctctacgcaaataaactagaaaatccagaagaagtgaataaattcctggacacatacaccctcctaagactaaaccaagaagaagtcaaatccctaaatagaccaataacaagttccgaaattgaggcagtaattagtagttgaccagacagattcacgggcaaattctaccagaggtacaaagtggagctgataccattccttctgaaattcattccaaacggtagaaaaagaaggactccttcctaattcattttatgaggccagcatcatcctgataccaaaacctggcagagacacaacaaaaaaagaaagcttcaggccaatatccctgatgaacattgatgtgaaaatcctcaataaaatactggcaaaccgaatccagcagcacattaaaaagctttatccaccatgatcaagtcggcttcatccttgggatgcaaggctggttcaacatatgtgactcaataaaggtaatccatcacataaacagaaccattgacaaaaaccacatgattatctcaatagatgcagaaaaggccttcaatgaaatacaacaccgcttcatgctaaaaactctcaactaggtattgatggaatgtatgttaaaataataagagctatttatgacaaacccatcgcccatatcatgcagaatgggcaaaagctggaagcattccctttgaaaactggcacaagacaaggatgccctctctcaccactcctattcaacatagtattggaagttctggccagggcagtcaggcaagagaaagaaagaaagggtattcaaataggaagagaggaagtcaaattgtctctgtttgcagatgacatgattgtatatttagaaaaccccatttttatgtaattatatataaattatataataattgccatacgagtttttaaaaaaagtcctgggtagagagaattcaagtctggcattatctttcttcttcttcttattattattatactttaagttctgggatacatatgcacaatatgcaggtttgttacataggtatacacgtgccatggtgttttgctgtacccaacaacccatcatctacattaggtgtttctcctaatggtatccatcccctatcgctcccaacccccgacaggcagggtgtgtgatgccctgtctcaaagatgcccaaaatctccttcagctgataaacaacttcagcaaagtctcaggatacaaaatcaatgtgcaaaaatcacaagcattcctatataccagtaatagacagccaaatcatgagtgaactcccattcacaattgctacaaagagaataaaatacccaggaatacaacttacaaggcttgtgaatgaccatttcaaggagaactacaaaccactgcttaaggaaataagagaggacacaaacaatagaaaaacattccatgctcgtggataggaagaatcaatatcatgaaaatggccatactgcccaaagtaattatagactcaatgctatccccatcaagttaccattgactttcttcacagaattagaaaaaactactctaaatttcatatggaaccaagaaagagcccatatagccaagacaatcctaagcaaaaagaacaaagctggaggcgtgctacctgacatcagactatactacaaggctacagcaaccaaaacagcatggtactggtaccaaaacagatatatagaccaatggaacagaacagaggcctcagaaataacaccacacatctacaaccatctgatctttgacaaacctgacaaaaacaaacaatgggaaaaggattccctatttaataaacagtgttgggtaaactggctagttatatgcagaaaactgaaactggaccccttccttacaccttatataaaaattaactcgaggtggattaaagacttaaatctaagaccgaaaaccaaaaaaccatagaagaaaacctaggcaataccgttcaggaaataggcatgggcaaagacttcatgactaaaacaccaaaagcaatggcaacaaaagccaaaattgacaaatgggttctaattaaactaaagagcttctgcacagcaaaagggattatctttcactctccctttgtgtttagcctcgatacaaatctcttacaagtttatctttgaggactaagcagtgagagggggcagcatagtcagagacagccccagccacctctgtcccaggtcacagatgattcacaaatgccctaaagttggcagatctttcttcctcttagtttacaaagcatagcatttttcaaaagaaatcttctctaggtatctcaatgaaagagagaagtttaaaagcatagaaacaaagagcagtttgcacttcccaggatttttgtcctaatgtatctgaaaatccagccagggatctgttagaacagagtcgtttacagagccacttccatgcctcccttttcttaaattcaatttgcagagaattttctcctcattccagtttctggtcagggaaggaattggaatagagtctcccattaatctagcaaaaacggttcagtatagtattaattgcctaaggaagacagcaattatcactcttctctgggtattcccttagagtgcccacaaaggttttaaatgtttctttgttccttcagtgaggtgctgcttctttcagttttcacaatagaaaaggctggtttttttgtttgttgtttgttttttacagagttaaataaaatccagaagctgttcaggagcaagatgcttctggctgggatgctgagcatggttaaatgatgatgatgatgatgatatcagctaccatttaacctccttgtttgtactagaaacttatctattgatgtgttttttttatatctcattcaattctcataacaattatatgaaagtagtagtattatcttcattttaccaatgagaaacttaggaacttgtttgaggtcagtgagtaatagatactttatttaaatacagatcttctgtgacctcaaagcctatatagtctttccactattaacacagactctggtgaagaaaacagtgttctaaacctattagtggggtgggcagaacaatagatgctatgtgttgcattcttagagcacttaaggtcatctgtgttgacgaaggggactgacgacataattttgcatttttcatttattatgtctttaggtacagatttctctacagtgtttaatgaagaggaaaaccaaaactgcccttaacacttgcttttagaagttttcctcttttcaccattagtttatcagagttttgttattttacagaaaatttggtagaaagaaatggtttgttgaataaaagctaatgttagataatgataagtgttgttaagggaataaaatatagaaaaatgagataaaagtgtttttttaaatgagtaatttccccatatttgattttgagcatttcatttttaatagcatgtttgttcaagaaaaaattgcattaccatattgtaagcttgagtacgtaatatatcaaaggaaatcctaattttaaatgctattcttttatacacatctctgccttcagaattagggatgtatttattatcctaagaacatccctttaacttgctaaccatagctgtaatgactcttagtgatagagccccaacttgtttctgaagcttggtgctttggggaagatgattatttcagaactgaaagttgatgggaacatggctgacaaatgggaagtttataagtaaaaagtcctagcaacaaagagacacctatccacatcaatatgggaaaaaagaatactgatttgttattgagtacacacaacagactacgtgcatgtagacagcacacaaaacctttgaagacagaatgacatttcacacaatttatacagcaaagaataagaaaatgaaataacatttctcttctttcctcagttacatctcaagataggctcctagattagctctaagagtatgtttatatttcaaggggttatgaggtctgcaaccttggagacatctttgcagtgtgaaactagagactgggtttatctagaccctgtggagaccatttatatctaataggttagagcgaggactcaagcacattgtgttttcaaggagactcaggaggataagagaaggaagttgcctccttcctcttcataagcaaataatcttcttctcatcttcctcctcctcctcctccttcttaaaatttatctttataacaggaagagtagagcttttccctttcttatctgtgattcatcccttggactggagtcaagctgaaatgagggttgggatgggtattctttagctatttatgatggcattgcatattcagtggcagcaacagaagatgcactgtcttaatttttgtgagttaattcagccattagaacaataagtgaaaggatagacattggcacctcctttatatggagttgcattatctgacagcttcaagttttgtgaactcagccaagtatgtatagaaagctctgagaagctaaaatatagaccacaaaatctgggtcaccaggcacgtaaaaagaattcattatgctctcacttactctctttatacatagttgaatatgcttggttgtctggtttcccagtccacaacagattagatacaatatggtaaaatacactatggttgggtagagttgcccctaatgacagcaaatgtgatagtggaaaacctgatgtcaatggggctataaaggaaaatgacctataatttgaaagacagaaactctaacaaatattaaaatatacattttagtacatatttaatatgtaaaatgtttgataaatactagacacttagttcatgtcatgtgttttccttttttcccctgcaagcattgctgtattacatcacagcaaaaaaaaaaaaatcaatgttcatactattactcttagttttgagaaatgtttatgtctgggtactctggaaaacagcagagcactgtgtgtatacattattagctctttttaacccaatatgttaaaactgaaacatattttggtattttaaaacataaacttaagtaattcataaaatttaaatatgttgagtaataatagtaaaatagcaattaaaagcactttacacatattagttcatgtaatttcatttatttatgctgaattagatgaaactcctcccattagtgctagattacagtacagtcatgcattacttaacaatggggataattgctgagaagcatttttaggtgatttcatcattgtgcaagtatcatagagtatacttacacaaatctagatggtagagcctactgcacacctaggctatgtataacctattgctctgaagctgcaaacctgtacagaatgatactgtactgagtactctaggcaattgtaacatgatgatatttgtgtatctaaacatatctaaacatagaaaaggtacagtaaaaatatggtattatcttatgggaccaccgttgtgtaagtggtcggtcattgactggaacattgttaggtgatgtatgactgcacttttacctggtatttgtattgtcattattttttgtagaatcttatttcacttttaaaaatgcacttttcttgagaacaggaatctgtctgactagtacttaaatttttgatcatgccttttgcataaaagatgcttagtaaacttttatgaagtcaattaattaaatctattgtacaattccgttggcactatacctttcttgtaatttattttttaacagggtagggaaaatagactgatgaggttcagcagaataaatacataaattaagcatggatggccagctcaatttaagtatgagacaatgtctattatcccctgttggtaataaagtactgttttttcagggaagttcaaatgttcatacaaaaataccaagccttaacacaggattggattcaggtttaaagttatcagttcactgacaatcttggttcacagtttggtgcctgttaattgaattgtagatgtaagattatttataattactgcactcttacccttcattttaatctgaattcattaattttacataatgtcagtagtaggtcaaattattgtaacaatgaactacagtccctaaaaattatgacaaaaagaggccagggttaattttaatttacagttttcagattttataacctatgtatcttatatgtgatcaaggcatccagaattattgaatggcccctgctccaatgtttcaattttaaatcagctatttgtaatcaaaacacaattatctgcttatgtgacatatttcttattatgttctcaggttactttctgaaaacctgttatctaaatacagtggcctggaattgtactcatctaagattttagcctgaagaaagctgggagtggactggcaacatagtgatttttctccttgtcttctagatttaggcctagaacaatatttgataccaacaaaggttgtcaaaggaatttgtctctcacatatttgtaatccatttttatctgccttataagtcataatacttctggtcttgggtctatacgtgccaggcatcatagaggcctagaactctggttctgagtttagatggacctgtgtttaaatcctactgcctctacctcttgatgatgtattcctagccaagtttcctaattccccatagtctcagttttctcatctataaaacagagataacagtagtatctatttcacaggcttgtcaagaagattaaatgatataactcactaaatatatgatgagtattgacattatagtgccctaagtcctttaatgtggtatacagccaaagcttttcaactttacaaattgcttctcattcaagatgatctaatcttttccctgacaaataattcatttctttatataactcatagaatttaaatagacattaaaaggtaaacaatctagctacattaatttttactaagatgtgaatcactggtaaccataactctccaagacttatttatgttttaagagatatctatcttttgaaatctgttaaatattgaaaatttaggcatgatgatgaattgaagtgaaagctttagacaatatatgtgaaaggtacatttggggcacattgcctttcaggttggttgtcattgctgagaggcctatcttgggtttagtttgtggaagtttaatctttatatcatatattttttccttttgtacttttccttcttaaagtcctggatttgttccaggatccctgacagataccaaaatctaaagatgctcaagttcctgatataaaatggtatagtatttgcatataacctttgcatataacatatgcatatcctcgtgtatattttaaattatctatagattacttggaatacgtaatacaatgtaaatgctatgtaaatagttgctatactgtatttttaaggaaataatgacaagaaaaaagtctatctatgttcagtacagatgcagtttattttcaagtggtttaaattcacaattggttgaatccatggatgtggagcccacagatacagagagctgactgtacgttctcgaaaaaactgaatcatttggcaaaggcaaggtgacctacaatagagggaggagttagaataaaggtcaggtcagttgaaggttgagaaagcaagatatgagaagcagcaatgactggttttatatgaagctgtgtgtaagtaggggactgcaactgatgggatgtttatgttcccccaaaatccatatgttgaaattctaatccaaatgtgttggtacttggaggtggagcctttgggaggtaattaggtcatgagggtggagccctcaggaatgagattagagcctgtgtaagaaaaagagagctagctagctagctttctgtcatgcgaggatacagtgaaaagtcagcagtctaaaacctgaaagagggtcttcaccaggaactcgacccttctggcaccctgattttggacctccaacctccaaaactatgagaaataaatgctgtttaagccatacagtttgtggtattttgttatagcagccctagctaagacaaggactaaatttattctcaaggttatagaaatgaggaagttaattcacttaatgctaggtttggacatagaagtagatatgtaatagctcatttaggtaattctgtaggtaggatatagtccattttaagggaacataccagttatttggagattagctttgttttctagaagtgaaaagcactatggggactagtataaactgtacggtttaagtgaaaagaatgtccagatgatgtctgcatttcttataaagacaccaagtagggaagttggcagagctctgccttctacttttggtgctatagagtttagaagaaagagtaatggaaagaaaaaggaactgggtacacatcaccacgggtactcatttcagtacaatgcacaccgtggtgctgtaatacttaccccagggacatagattaaggtgccagtcttgcttctcagacacttaatggaaattttgactgtctgcagagataattttttatattatattcaagaaataataaatgtaataggatatagaggaatgaaactttctagttacagaaatatttaacatagtttcactttatcttcaaaattaatccttaaaaacagatagaactgatggtcttatctctgagttgtagataaggaaaataagattgccaaaactcgtatagcttcagattcagaaaaaaaaaggcagatcttttttattctctgtggttctttctgtcatattacttatgtaaaatgacagtgaaacaaaatgcccaggctttggggcatgtgaagacggaataattttcttctagctaacacgttttttctttttttgagatggagtcttgttctgtcgcccaggctgcagtgcagtggcatgatctcagctcactgcaacctctgctttccgggctcaagcaattttcctgcatcaggctcccaagtagctgggattataggcacccaccacaatgcctggctaatttttgtagttttaactctgtctccaaaaaaaaaatacaaaaaaaaatttagccaggtgtggtggcacatgtctgtagtcccagctacttgggaggctgaggtgggaggatcacctgagcccaggaagttgaggctgcagtaagctgaggtcacaccactgctctccagcctgggtgatggaatgagaccctgtcaccaaaaataaataaataaataaataaataaataaataaataaataaataaaatacaagagacccaaacagataaaacacccttgaactatgaaggactaatactttctgatttcaaaatttattttaaaactacagtaattaagatagtggtcttaattggacagtggtactgctataaatatagacatgtaggccagtgtaataaaattgagtgttcaaaaataaacccttacctttatggtcaattaattgttgacaaggatgccaagataattcagcaaggaaagaatagtcttttttcaacaaatgtttttagtacaagtgtctatctccatgtgaaaaaataagtttgggcagctaccttaaaacatatacaaaaattaactcaaaatgggttgtagacctgggagaaagatcaaggtggctgactagaagtatcccgcagtcacctcctccacaaaaaaaaggaccaaaacagcaagaggataaccacacattgaatagagtatctaagagaacactgaaattcagcaaggaagtgacagggaccctctgaggcatagagtgagagggcagccaagcagctggcctggccaggatcggtttggaatgaggaaggtgtcttcattgtggggaaaaggtaggtgagagatccccagccatccactttcccaccacagatgctggtaatactagccacaagagagccactcagcactcacaggcccttagcctagtacagggagctgcctagggtctgtgcaagtgaattgttgcagagagggaactcacactggctcccactcactccccgagaccaaagcagctgcagcatggagccactttgagaacccaactcccaccagactacattattccctgaggcccaacgggccttgcattttcacatccccaaagtcccacttataacccctgtattcacctagaaagctgcaacaccacaatgacagctaaatctggcattgtggcttggtccccaggattctggcctatgcagtgcactacaccctggggaacaggtgatagagcacaccagggtggctgcccccagtactgatactccccagagccttagagctgcctgttctgggctgctgcaactcagaacaacctcccctccactccaacttcacaactgtgtgcaccttcatagggcctgaggacaggacttccataggcagactgtctccagtgcccacatacaccctccggatacctgcatattggcctgccccactcatagctgccaccactaccacatgctcatccatccggggccctgagggcaggcctgccctgatcgccactgttgatgcttgtgcatgccatccaggagcctgagggttcgtccgccttacgtggtactaccccgctttgcctgtatgcactattttgaagcctgaggatcagcccatccttctcaccaccacatgcccccttgtccactagccagaagactgaggacaggcctaccatgttcattgccactgacatatgcctacctgctgccatctgctgtcatggtcactaccactgcacatgtgcacttcccaggcccccagagacaggccactcaacctgctgctgtactcctcatctaggcattccatccaagatcctagggactggtctgcccagcctacaaacactacttctggtgtcttcactcccacgggcccaaggctgtcctgccactgctattgtcactgccagtgctatgcacactgtccaggggcccaaacacatgccaacctggccctcctcagctaccactaatgtccaagcatgctgcctggggcttgaggatcagcctacctgggtcaccccacagccattactggtgccagtgtatactacccaagggcccaaggactggcatgcctagtttaccagcaacatcactcatgcccaaggaccagcccacctggtgaccttgtccccagcaagtccttgtcacagctgccagcaacaactgcagccagtgtcactgaggaactcactgctcacatttattacagccaaagaaatcatacagagactacactactgcactttcccagaataaaagccaaaacaccctactgaacaaacaataaagatctacttacagggaaaaaaatctttcccgactaaagccagtccataaaattggaacaagtgactattaagacagatgcagaggtatcaacataaggacacaagaatgagaaagcaaggaaacatgacacttacaaaggaacatactttttcagtgacagatcctgcagaaagaaaagtctattaaatgtccgaaaaaattcaaaataatgatcttaaggaaacttagtgagatacaagacaacacagataagcaatataaagaaataagaaaaataatttatggcctgaatgagaaatttgacatagatgtaagaaagaaccaaacagaaattgtagaactgaagaattcaatgaatttttaaaaatacaattgatatcttcaacagtagactagatcaagcagaagaaataattaaacttgaagatagagcttccaaaataacccagccccaataaaaacaaaaaaccaaaaaaattttaaaaagccaaaagaaaataaaaggagtgaagaacatccatgtgacacatgggatgctataaagtaaacagatatatttggattttcagaaggagaagagatgggcaaagctatagaaaacctatttaatgaaataataactgaaaatttcccaagtcttttggaagatatagacatccagatacagaaaggtgaaagattcctaaacatatttcatctaaaaagatcttttctggtgcatgttttagtcaaacaggcaacagtaaaagagaattctacaaacagcaagagaaaagaattcagttacatgtaagggaagccatatcagactaacagcagattttccaacagaagtctgacagcccaagagaaaagagaatgatctattccaagtgctgaaaggaaaatactgccagccaaaactcctatatccagcaaagctatctttcaaacatgagggagaaataaatctgtcaaaacaactccagagaatcaaatagaaggaaattcttcctaactcattatatgagaccaacattacccttatgccaaaagcaggcaaggacacaagaaaaaagaaaagtacaggccaatattcctgatggacaaagatgcaaaactcctcaacaaaatctagcaaaccaaacccgatttcacatcaaaatgatcatttaccgtgatcaaataggaatcccagagattcagtgattgttcaacctacacaactcaataaatgtgatatgttacatcaatagaatgaaggacaaaagccaaatgttcattttactagatgcagaaaaagcatttgataaaattcagcatcccttcatgttaaagactcaacaaattaggcacagaaagagcatacatcaatataataagggtcatatatgacaaacccatggctaacatacatactgaatcgggaaaagctgaaagcctttcctctaagaactgagacaaggcaaagatgtctgctttcaccactcttattcaacatagtactggaagtcctagtcagaaatcaggaaagagaaagaaatataaggtatgaaaattggagaacaggaagtcaaattttccctctttgtaaacaacatgatcttgtatataagaaaacctaaagaccccataaaaaagaatctcttagaagtgatacacaagttcagtaaaattgcatttctacgcaccaataatgaactagctgaaaaagaaatcaagaaaactatgccatttacaatagctacaaaaaatacctaggaataaattaaacaaaaggggtgaaagattgctatgatgaagactataaaacactgattaaagaaattgaagaggactcaaacaaatggaatgacatcccttgctcatgattggaagaattaataatgttaaaatggccatactaccccccaaaattttcagattgaatgcaatctctatcaaaaatattaatgacattctttacagaatttgaaaaaatatcctaaaatttgtatgagatccacaaagaccctaattgcgaaagaaatactgagtaaaagatcaaagctgtaggcatcacaccacctggcgtggtgtgattcaaagtatactacaaagcaagagtaatcaaaatagtatgctattgatataaaaacagacacatagatcaatggaacagaatagagaagtaaatccacatatttacagccaactgactttcaataaagtatccaagaacatacattgggtaaagaatacactcttcaataaatagtgaagggaaaactggatatccatatgcaaaagaatgaaagtagactcctctctctcaccatagacagaaaccaactcaagatggagtaaatgcttaaatgtaaaatgaaaatgataaaaccagtagaagaaagcatagggaaacacttcaggacattagtgtttgcaaatattttatgggtaagactttaaaagcacaggtgacaaaaaagaaatataggtaaatgggattatattaaactaagaagcttctgcacagcaaaggaaagaatcaacagttatgagacaacctgtagaacgggagaaaatatttgcaaactatttatccaacaagggactaatacacagactatacaaggaactcagacaaatcaacagcaaaaaacaaaacaaaacaaaaaaaaacccatttaaaaagtgggcaaagaaactaaacagacatttctcaaagggagacatacaaatggccaagaaatatatgaataaagcattcaacatcactaattgttagggaaatgcaaatcaaaaccacaatgagagatgtcactccagttagaatggctattatcaaaaagacaaaaaataacaaatgctggcaaagatgcagagaaaaggaaactcctatacactgttggtaggatgtaaattagtacagccattatggaaaacatcatggaggtttctcagaaaactataaatagaactgccatacagtttagtaatcccactactgagtatttatccaaagccagcgaagtcaggatattaaaaagttgctgacactcacatgtttattacagcacgatttacaatagctaatatatagaatcaacctaaatgtcaatcaatggatgaatggttaaagaaaatgcagtacatatacacaatgaaataaaaaaagaatgcatccgtgtcatttgcaacaacatgaatgagcctggaggacattatattaaacacaactaatcaggcatagaaagatcaataaccacatgttgtcacacatatgtgggtgccaaaaaaacattttgagcttatggaaatggagagtagaattgtgggtgaggttgggaagagtaggggatagagaaagatgggacgaggttagttaacagatacaaaaattacagctagataggtggaatgggttctggtgttctgcagcaccttacagtgaatatggataactataatttattgtgtcttttcaaaaagctagatgagaggattttgaatgttcacaacacaaagtaataataaatgtttgaggtgattgatacacttgttaccctgatttgatcattacccattgtacacacattgaaataccattctacgttccataaatgtatacaattattaaatatcaactagaaaaagggaaaaaatggattatagacctaaatggagaactcaaatgatattaataaatctcttagaaggaaacatgggaatatggttccatttatatgaaacatcagaatgggcaaatctgtgaagactagattagtagtttgcctatgactgacgcagggagggagagagatgaagactgactgctaatggaatacaaagtttcttcgtggggtgatgaaactattctaaaagggtttgtgatgatgattctgtaattctctgaatcgtctgtaaaatccactgaattgtatactttgaatgggttaattctatggtatgtgaattttatctaaataaaaccattaaaaataaagacaaaggggcctcttcacctctattatgttctccttcctgtgactgttttccctaaattctttccaagataatgctcagtttggatggaatattagttctccttttgctgaaattttcaggtaggtttggtggttttccatcagatatttttcaaaagagtgtcttaaatgggggttaccttttcctttggaacattatgaaacatttatacaaacagagctgtagatatatgataaaagatttaaaattcagttatggagctgggagagggctcaaatcacattttgtagctcgtatttttctacattattcctcgaaatacactcaatcaaatatatttaccaaaataactatgtactagctttcaaatccaacagcttaaaccacaaaacactaattgctacctcctttgaaccttgtaatacttctttttctataatttgcttataattaccatatgcaggcttgtataaagttaaatatatatgtttatatattacatatataatatatgtaaaataataatttgcatattatatatatttagcttaatttataaattgtaagtcaatagacgaaagctttttaaagtttcctaaagacctaacacagttcactacatatatgagctaattaataagtgtttctagttgggtagtagataatgccagtctctacaccagagagaaggggttgaacattaatgtgagtggcttttatcagtaatccagaaaattatagaatggcaccttgtatagtctgtgtattagtcccttgttggataaatagtttgcaaagattaaagatactctatacaatcttacagggctcatcagttagtagctcatttttgtacagaaaatggtagctctgtgaaatagaattggcttagaagactttgacttactggaattctaagtaaaattcaaaacgtaacttttcctctcacacatttttacaaagttaaaaacaaatgctgaaaatacttcatttggtacaagtattccacatgtgcaagatacaatacagcaataagatggaattttcaataaatgactaaacattcaaataagcatctttcataggaggtccttggcaggcagcacacttttcccactaaggctgctgttataaaatcatttttggagctattcttttggaatgtctgtccttctctcaaagccagtgtacaaattatatgaataaacagttttggtacttttccatcataattgtttataacaaaaattataatactccagttagtcaaccacttcattctagggttagctcactttggggtgcttccaaaattatatccactgttaaaacaagaagatatgctaccatttacagttcttaaaaatggattttgagctttgtaatatcactataacaaatgtgtatcttggttcactgccaggtacatgttgagtatccaatcaaatgttggtataatgagtgaatgaattaatatgatttttctgttactttaaagggagtacatctttagcaatatctgtatatgtttctgaaaaatcaattatttcatattcactgattgtgtgcttatgcttgctgtttgaactctttattttctgctcatggcttttgacctatttatattgacatacattctgttgatttttatatagctctaattgcaaaaataaaaattgaacaacatgtaaaaagaaactcgttccagcattttcaccagctttccatgccttctctgttatgattggtagagctctgtgatgtcttcagcctattttcaaatttctgcgtaataaacttcattgggcccacagatctgaatccattaagttactttaagtaatcagtgtccagatccttccttatttggtcatggtgttttgcactcttattgcagtggctgcttttctggtcctttgtagaaacagagattttctggagtcatttatagtattcttgctctccccatttaatacattgggttagatttctaatttaaaaaaaagcatttcttatttcttttagtgtttttcaaaacttgctatttattaattttttggtctgtcctttctttagcctcttatcccatgaataaataagtacatatgttgaaaaagaaggaaatacaatggatttatacacctttcaaaaatttctagggctcagcctctacagactcaaattttaattaatagtttacttttttttgtgccactgaaatttactaaggcatatgtaatgaaatatcaccttttcaggaagcttccactaatggggctcagctgaaatgccttctccttcctttgggtccccagggctttgtggctttgtttattttgcctcatcttggagtaatttgtgtatagttcttagttgttttaaacagtaataataataatagcaatgattagtattgattatttcctttgggtcagatacttgatgtgtaagatcctatttatttcttacaactatcttacagcaaaggtattattatcatcttcattttatcatatgtcattttatcacatgtagaatcataaatatatatgtgagtatatatataagcagaaacaatccttataaaaaccacaattttttatatatatatatatatttttttttttgagttttgcaatatcactataacaaatgtgtatcttggtgtactgccaggcagatgttgagtatccaattaaatattggtggaatgagtgaatggatttatataatttttcagttatatgtataactatggtttttataaggattgtttctgctgataatgagaatttgagcaaattattctgtacaaaataaacctgggttacattttccccttcagaaccttttattttcttatatctaatcctcttgttagggacatttgaaattggcctctttttggtcccttgagacttactttatttctgcttggtgcctatagaatttttaatttaatattgaagtttaataaccttttcccctgatacatggtgtgccatttctaccttactattgaattctctatttcacagaaacgttcctgtattatatctttgaataattttctatttcatttgttcagttctctagtttaggaaaataagaggaaaatatgaaatggttagatgctaagtagatataagacattataagaagcaaagatgaaggaaatgtatcagatgtacagttcagaacaagtagtgtcgaagaggtcagagcgtctgggaaacccaatcaaaatgtttcccctgaagatctccgtattgtgtcagccatcatagactccctacaatagtacaaatagaacactgctccttcttaatcgttttttaagttagtatttaaccctcatttagtgtgtctttaccatgtgctaagtcctgtaaagacaaaagatattaatgctttagtctaaaatctagatttttttccaccaactttggattttaaaaagttttaagcttccagaaaagttggaaactagcaagatgttaaaacaaatctagattcactgattactctttaaaattaaattccactgtcttctaaaatttcagcatgtatctccaaagaagatgattcatctacatagtcacagtaccccccaaaattaactttgaaagtatattaccaaagatgtagtttatattcacattttcccaattttctcaacaattttatttatagattgtctctcctaggatccaattgagtattacacattgcatttagttttcatgtttctttaacatcctttattctaaagtgtcctgatgttaacattttttagagttctacaatctgaatttttctgattgtttcctcatgattagattaggttaaatgtttttggcaagagctgtatcacattaagtggtacaaaatagtagtttatcctattctttgtaatgttatcttaaattacttagttaaggtgttggctgtaaatcttttcgttgaaaggaaaactttcctttggtaattaacaagttatctgtagggtgacactttagaccatatgagcataccgttttccaacaacttttcattgaatggatttagaaatcattaatgatccttgccagaatcaattgtattcgtgttggcaaaatggtgattttctaattctactcctaatcttcttaagcacaactatgacctcattaaggtagctgtcccaaattttctgggcctcttttttttttaaaactatctggtagatacagtgagatctcttttacaaaaaagaaataagtacagtgttaaatgtctaatgagcatcaggaacacaaaaaaattgtacctacattgacctgctctttaacttcttccaatatggaagagatagtcagtgagcacctgagtgatctttcaggaaagcaaagacaatccacgtaacatgtttgtctctagcactcatccttggatatgtctcctttccttcatgtaaacagttaagaaacacccaattgtaaatataaaactcattctgaaagaagagggggagcaatactgtaaggacttcaaatttcctactctattattggaaaatggagcattttttttttttaatcggccgcagggatttttgttagtgtttttgttttattttaattaagaagaaaacattaattctatgaaacataagccatttgctttccatatatttggcctggagtagactctggacattgataatttttcaaaacatctccaggtgattctaatgtacagccaggattgagaaatttttgaagaacaggtaactccatcttgaaagatgggtggaattaggacatgtggagattgccggaggtaactttaggtgaaggaaataacataagcaaagattaacctactgatggcaaggatttgccattcttttccacaaatgaagccttttttttctgttatgtttacctgaaaggtaattggaaaaatgatgccttaaagttcactaatttgtgagaatcataggcaaaagctttcctgtgatattagagaagagtaagatattgttcttgataacatcctgcaactcatcatttatagcataataagcccttccactctgattctgttagacaggcccatccatggcaagatattaaacaaaacaggatttattgaaaacatgtctgataatagcaatgatattgaaaaagagcaaaacagtacaatcctggtttttatgtttctgctttgaccacaggcttaaaatgtgtatttcaagcctataaatattgattgtgagacacaagaaacataatataaatattttgaaggaatagtaattaagagcagtgagtcacaggtagctaccagatgaaaataataaacccaactttgtcagggcttcagatcagagtaaggtttcaattttgatatccacggagaagagccaaattgaagatgaatatgagtaaatattgatgatccatactactgaatttgtctggtgataaatgtttcttaggtattgcacatattccgaactcataaatacatatactacataaaaacatggaaaaaacccttcagaaatgttttcctgtattatattttcagaaagtcacaagttttagagaaatcatataagcagaatggcagacagcatgggccatatttccatgtcaaaagtaaattgaaaatctaaattagtacctgaggttaaaaatacttatgtccacagattccagaatacaaaggaaaagtaatgccagccaaatctgaaacataaacaactataagttttctttgtatttgaaaatatggccttggaactctgtataagaagatgcttacttcataaacatacatgtgcaagtgtctttttcatataatgacttctttaagagtgccctccaatgatatgacaagatgctgaccgatgttatacctcatttcctgaaagtttctaagtgctctatgatggatcctatggtggtgagagtcaacaacctttgtcataataaataggagatttttctcacaattttcgaagtaatgtgacattaaaaataaggataggaaggagacaaggaaagaagaatcagtaaagtagtaagaataattagtattgtgtcaggagaactaaattctagttgtgtctctgtcaccaactagctagaaactttgggtaaaccatcttacctattgacttcacttgcaaaatgaacattaggctgtatttcaataatttccaagtgtttgaagaagtagaacctttatcaataaagtatagtatagaaaactttctttcctccacttttaaattattcctgaagttctgaccctttttcctattctttactttcaaatgcttttaatttcaacttctcccacttgctgttacaccctaatatatctaatacgtctctacaggtatatttctgtgcctttcagtagccctctatgttcatctactttttaattttttttatttcaataggattttgggaaacaggtggtagttggtgacatgcatagattttggtgcacccatcacccaagcagtgaacactgtacccagtgtgtagtcttctatttctcaccaacccccatcctttcccctgagtccccaaagtccaatgtatcattttgttttattactttttttcttaaaaatattcagatattgtatcttattactcctttaagctactcatccattctacatgttttccttataaacttttcaaaatggtagcaattgttttcacaagcagagccttatgggaattttacatgtgtggaagaacataataaatttggaatttgctgatgatttcacttttaaaaataaataaatagaacctttttctcccttgaatgaactcttacttggaatcataatatgtaaaacagatgaaggcaaagatgcaggagaagttcttgagtcctaccctttcagccattcccatccttatgagactgacatggcactgccacagacacccaagggccttgctactcaaagtgtggtccaggaatcagctgcatcagctggttagggatacagaatctcagaagcttatttgagaatcacaagctccagtgggacctactaaatcaaaatctacattctaacaggccccttccacccaccacccaccttcattcctccctaccccctttttcctcaccactatgatctggttcacactaaagtttgagaagctccgctctaaatacagatgcaactccatttgaaaagtaactactggactagttaactcatagagatgaatgatgttcattttgtcctttcacacaccacactgactgattctcagctggaagcccagtgtgcaagaagaacaagaaatagtggcactaatgccatttttagtcttatagaaatataggaatatagaatgcagggttttattttatttagtagacagtccagtggtctgtttattctacaacactgactcaaagaaagggactacatagtggcctttatgtatattagcatatcagtcagggccccagcaggaacttaatgccacactcagtgggagacttcttaacaaagttgtgggcaatcttaaggaaaccactaagggatggtgaagccctagggactagcaatggtgggaaccactaacactgtcaatcttgatggagcaagggaagggatggaacctagggaaagctttaacagtgggaagggcccactgtgggatctcttgccttaggtgggagaataagccactgccaaatcacagatcagcagagagcaaaccaagagaatgaataaaccagactttctctcctctcccactctggtcacctgccatcgtttaccattggccaaacccaactggaaactagagtgcaggggaatgatttgatgcagtacagaaaagtcatcttcctggggtacagagcagggtacagaaggtggaaggtggttctgaagaggaaattcagaatatctaacatgataaatagttggatttgtaaataggaaaaaaaaggtagtaaagtaaaattctaatggaaaggtttcatttgtgcttgttttgtttgcatatatgttcatacacttatgtgtgtatgtatattaagcacaagggggaatttctaagacatagtgagatgtagcagaaaatgtgtactttgaagagactttatactttcttctgctgtagaaagttttagataagagaacgttgttaatctgtatttatctagcacatacccttttgtaggcactgctaaggacactcaagtataaaacatggtccctccctcagagaactatgatcttggttgaagggcaaaaacatcaaatatgtttataatatgcacatggaatggaatgctttatttcgttcattcagccaatatttattaagcacctgctatataccaggcaatgtctttaagtcgagtcagaaattcaaaacaaattccctgtggacagggaatttgtaatcttgtttgaaaggtggactttaattatacatttcaagcatgataagtgttttgaaaagagaaatacggagttgtttaggaatttgtatcaaatacacctaacatattggggagccaaaaaagcctcctcgaagcatttaagaagtataagtaggaagttattcaggtcatagaggatagtaaggtgaagggcagctgggggcagtagagatgagggtgtttgcaggggcgtactagtagaagggcagagaagatcatgtgttcaaaaggcccagggagaaaagagatcatggcatatttaacaaagtgaaagtaatctattataactggagcagaaagtaaagggagtgtggtattgtcctttatcctacagcactagaaaggtattaaaatattctaagtaaatgaatcactccatcaaatggaaaaattatgaatataaaatttggacttctattattaccattttgaactaaaactttatgttgatgtgtttatttctaaagtttttctgagaaataagcacaagaatgaatttttctcaaaattttttccgaagtttattttttacttctaatttaagaaaatagctgaattgttcggaattttctgtcatgttttgctgtatattaaagtaataacatcttttaaaaggaaattggcaagtgttctttattagcaattttataaagatagaaccattttaaattgattgttgccaaaagtagaatacaaaaagtatcacagaattatgtgaataattaggaaataaattttacacctctttatgtgtatgtatgtgtgtattcttactgctggaatttcttaatctctgtcagcaatagcacttactttcaaacttcttcatctactgcctcagcttactgatacttctatatcaatatagttattttgcctttctggagaaggtaaatcacaaccaatatgtatttctttgaattctagccaagcaaaaaggacatgcagagtccctcttgagctagaagcgtttatgcagatggtatcatttcatacaaacatgtattgtcaaaacccatcataagatcactgtcagaattactggggatcctgtcaatcatatgtttctccatgttattatttttccaagtatcttctttcaccactacagtagccctgatggatattaacacagaaaaaaggaatagtgccatcaatagtgcttcttttcttccaataacaatatcatcatttttggcacagatgagagataccttatttcttaggtgaatgtatagatggagggacacaactgaaagaatgacttcttaatcagcttacaatgtcatattttcaaactttatggattcagtggctcatgttaaattattttacagtagacatttatatatatatgtatataatactttaagtcttagggtacatgtgcacaacgtgcaggtttgttacatatgtatacatgtgccatgttggtgtgctgcacccattaactcgtcatttacactaggtatatctcctaatgctatccctcccccctccccccaccccacaacaggccccggtgtgtgatgttccccttcctgtgtccaaatgtcctcattgttcaattcccacctgtgagtgagaacatgtggtgtttggttttttgtccttgcaatagtttgctgagaatgatggtttctagctttatccatgtccctacaaaggacatgaactcatccttttttatggctgcatagtattccatggtgtatatgtgccacattttcttaatccagtctatcattgttggacatttgggttggttccaagtctttgctattgtgagtagtgccgcaataaacatacgtgtgcatgtgtctttatagtagcgtgatttatattcctttgggtatatacccagtaatgggatggctgggtcaaatggtatttctagttctagatcccggaggaattgccacactgtcttccacaacggttgaactggtttacggtcccaccaacagtgtaaaagtgttcctatttctccacgtcccctccagcacctgttgttccctgactttttaatgatcgccattctgactggtgtgagatgatatctcagaaataataccacacatctacaactatctgatctttgacaaacctgacaaaaacaagaaatggggaaaggattccctatttaacaaatggtgctgggaaaactggctagccatatgtagaaagctgaaactggatcccttccttacaccttatacaaaaattaattcaagatggattcaagacttaaatgttagacctaaaaccataaaaaccctagaagaaaactaggcaataccattcaggacataggtatgggcaaggacttcatgtctaaaacaccaaaagctatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagtactcaaacaaatttacaagaaaaaaacaaccccatcaaaaagtaggcgaaggatatgaacagacacttctcaaaaaaaagacatttatgcagccaacagacatgaaaaaatgctcatcgtcactggccatcagagaaatgcaaatcaaaaccacaatgagatatgatctcacagcagttagaatgacatttttcaaatcacgaagaaacccagaaaatttgtatatagtaggctctgatcttgccaaatgtgggattattctgatacatagtttatgataaattacaccaattgctcatggtctgcggctgcttataaagatgaaaatttgtttgtccattagttattagttaacagtagatatgaataaatttatgaatatatgtatataaatttgcaaatatttgatccctctgaaattacaactgaattctacttgtttccaaaatgttttcaactttatacattttcatttattcattcatacattgattgactctacaaatattcactgaaacactactgtgtgttaggtcccatgctagacctatttttaaagttgacttttaaacagatcctgctttgaaaaagctttcagtttagaaagggggtaaggcacggagacatactacaagagacaatgtgctaagcaccaaaagaaagtcttgtgcaaagccattctacatctgagacaagtgaggttatttctacttgagagggtagggttgcacacgagggacaattttataatggaggtgacattgggaaagcatctcccagaatggataggacagagacatagcaggattggagaaaagcacatttttccagcctgtgaggaaagtattagcatagagtgtgtgctcagaatagagaagatgcaaagcatggagtaagacaggatcttgaaaaggcttggaatggtgaccagactgcatgttctgcaaatggaaaaataaccaaaaactattattaaacataaatagcaaggggattcttctcaggaagaaactaatagtatggtggggattcatttgtttgcaggaagggaacagttgcaatacagtggtgactataaatttttatgtactaatttttcagtatacagtagaccattgagcaacacagatttgaactgtgtgggttcacttatatagattcttttttcaataaatacattggaaaatgttttggagatttgcgacaatttgaaaaaacttgcagatgaaccttgtggcctaggtatattgaaataatttaaaagttagttatgtggaaagcagtgtggtgattcttcagagagctagaaacagaactaccacttgacccagcaatccgattactgggtatatacccaaaggaatataaatcattctaccataatgatacaggcacacaaatgttcactgcagcactcttcacaacagcaaagacatggaatcaacctaaatgctcagcaatgacagattggataaagaaatgtggtacatatacaccatggaatactatgcagccataaagaactacatcacatcctttgcaagggacatggatggtgctagaggtcattatccttagcagactaatacaagaaaagaaaagcaaatattgcatgttgttacttgtaagtgcaagctaaataatgagaactcatggacacaaagagggaaacaatagacactggggcctccttgagtgtgcaggttgggaggtgggagaggatcagaaaaaaataactattgggtagtttgcttagtacctgggtgacgaaataacctgtacaacaaacccctgttacaaaagtttacctgtataacaaacctacacatgtacccctgaaccaaaaataaaagtttaaaaaaatgtagatactagtctgtttcatcatttactactataaaatatatacaaatatattgcaaaaagttgaaatttataaaaaaacttatgcacaaaaacactgactctacccggcactaccacttgcagttgagagaaatgtaaacaaatgtaaagatgtagtattacatcataactgcataagattatagtacatactgtactattgcaataatttcataaccacctcttgttgctgttgaagtcctattgtatcctcttaaaatggcatgtgatgctaatcagatctgcatgagcagttcatctctccagtaaattgcgtattacagtaaaaagttacctctcttggtttttgtgtattttttacagtgtttagtgcaataatgtaattcttgaataacaccatggggcccacatgaagtcccactggtgatgctgaatgtgcttccttgaggcagagaaaagtcatgacattacaagaaaaagttgaaatactttatacgtactgtatattgcggcctgcagctgcagttgcctgtcatttcagacagacgattcatcttgtaaacagacaatgtaaacttatggtattgataaatatggtacagtactgtatatgtattttctcttttgattttcttaataacattttatttttctctagcttactttattgtaagaacataatacataatataaaatacaaaatatgtgttaatcaactgtttatgatattggtacagcttctggtcagcagtaggctattagtagttaggtttcaggggagtcaaaagttatacatggaatttcaactgcatgggggaccagcgctcccaatccccatgttgttccagggccaactgcacttttttcattcttaataatttactctttttaatctctatatggtttataaaacttttcatttacataattgtttcttaaactcactcaatacaaagaatcatttgggatgcttgtaaaagatagcatactacagttattatagttattccattatcttccacagaaaatttttgcttagatttacctacattcgtcccattctttgtttcctatttttttaatcttaggttattctgggttcatttttctttgtttcagtaatgcacttttagaattttcttttgtgttattcatggagaagtctcttggtttgtgttgatctcattagcattataaaaatatagcttttctgagtgtaccacactaggatgacagttattatttctcaatccattgaaaatattattccattgtgttctggtttctattacttctatatagtgtcagtcttctctctctgcttttatgatctctgtgctatctgtggattcatgactaagcgtctaattctggattttgttttatttatatttcttggtggatgctgtgcttgatatcgtgagttcatatttttcattacttcagggagtttcacaatctggtacttcaaaatttacctttccccattctctttattctccccattctctttattctctccctcaggtactctgattaatttagattttcacattctatatcatatattacttgatctcctcatattttctactctttagctctttgttctacatgttacggtatttttagatcttccagttctagtttatttactttctttagtggcatctaatattttatttaacccatctgctgttttgttttactttcaaccattttttaaaaatttataaaggttctattttcttttccaaatatccctcatcagtttttaattggctctcattgtattttgtgatgtcattctttacttctttaaatgtcctatgtatattttatattccaagtcgtaaaatctagtatttgatgcccttggtgagctaaatctattatgttttttcctacctactctcatttctggtggtaagttttattgtaaatttggtgattgttgattgttaccttatatttgactttattttattctgaggaaaactaggatgcctaatttaaagatatattccatgtaagagaaggttcatgtgtttccacagggattttggagacattacaaacctagaacaaatttagccccttccagggtttcaggtataatccaagaatctcattttcagcttatcttccttgctgctaaggtaaagctaaatctccaaaccacagtgcagagactggcatttaccctcaagctatcctatcttaagtatgcgctttcagctcatagttaagcttttagctcaacgtttatgcttttatttttgcttaggccccttggagattttcctcacctattttaagcccagcagtgttatgaaaattatattttatgcaaaatctactttttttgtttgtttttcatgaggatccttccagcctactgccagaagctgaatgatagatattttttgcctatagcacaatgacagtctggaaattatcaagttgttttgatcaatataggtaagccaaactggaatactttagaataaacaaacaaaaatgaacttggcatctgatttgtccagtttagtagtctctactgattcttgctactttgtgctatttggatgcaacgtaaaatattgtattagtaaaatatttaaaatgagcccagatgatattatgctaagtgaaataaaccaggcacagaaagacaattactgcatgatctcatttatatgtggaaactgcaaaaaggctaatacatagaagcaaatagtagaatagcagttacaaggggttggggtatgggagaaatgggcaggtgttggtcaaagggtgcacatttgcaagtataagatgaataagttctagggacctaatgtacagcatgatggctatagttaatgtactatatatttgaaataggctaagaaagtagatcttaaatattctcgccacaaaaaataaatatgtgaaatatggatatgttaattagcttgattatggtaatcaattcacagtatatacatgtatcaaaacatgatgttgtacacattgaatatataaaatttttaatttatcaattgtaccttaataaggctgaaaaaataatttctcttttacagagtggtgactgggccactcggagactactgcatagctcttctcaaagcttctttttctttattctaatatgctttgtaatggaaaattgaagggaaagtagagaattgactcattaaaaagtctaagacattaaaagatattttgtctatttttccaatagttaataatctttacttacggttgattaagttcatataagttaaccattccattaatatctatagagtgcctacatggcgtgtactgttccacatggtagaaaacatagcaaggaacatgtagatagaaatcgctactcttatggatctagcatcctatcatcatgatagacataaatgagaaaaggtagtaaaataaatagtacggtagatagtaagtgctaaggagaaaaataaaacttggaaaaggaatcaagaatggtgaaagttgttgtaatattagatgggtatatggattcactgcttctgagcattttcttaatgcattctgtggactgttagatcacaggcggaccactcccataatctagtgaacagattatttaggagagtgagtgttatgggttaactgtgtacctcttcctaagatactttgaagtcctaacccccagtatctctgaatgtaaccttatttggagataagtttctttacagataagtttctctattatttctttacagaaataatcaagttacaatgaggccagtagggtgggccctaatccagtatgacctctgtccttacaaaaagggaaatatttggacacagacacaaacacagggagaatgccatgtgtaaattagagttatgctgctgcaagccaaggaactaccagaacctaggagagagaatggagatctgtcaacaccatgatctcagactcatagcctccaatacatatggcagtaaatttctgttgtgtaagccactcaattcgtgatacttccttacagcagccctagcaaactaatatagacagcttaatagtatgtaggacaatagtaggtgctgagctaagggctctaaaattacttctagcccactgtatagctgctttcatttaatttaacaaatatataatgtttatgataaattagggactactgtagaaaatttgtaaatattaaccaatgtgcatccaaataacaattgtgttatataggttcatttattattttaaagatgtcaggaaaacattcaagcaaacattgcatggcagggcagacattcttagaccttatataggggattttcctgagggtgtcatataacacatgcacacttatgcaagtttttaaaaagctcattctctagtgatagtgaaagacgtaggcaaaggacatgctccagacaagaatacctgtatcctagtcctgcacctctgtttcctgagccgtagaccctggacacatcatttctttcagcctccatcttacacctcctaatactaactaggttactataaaattaagtcagatgataattttaaatgttaaaataaacatcaaaaagaaataaagtctctaatacatagtttgccctagagattttcatttttagagggattattccctcaatattttctcaaataatgtattaatttatacactgcttgtgaacactgagatttaagaaaccatttaaattatttagagaatacttgaaaggctttaaaaccatctgactggaatgcaaactacacatacaattactttcaaagagataaaaattgatatgaaattataattcataatgattaatgttgaacgagcataaaaccaactgcatatttgtcctttaagcaaagctttggattcagaattatagattaaaatatgtgttaatcttgggacttgcctttaattaatttatggcatagaacctaaaaatgggaagtatattaattaaaatgagagtgaatatagtcagactgggttgggaaagaatcttgatggattcttttcaccacattcttagtatggaggaggtgcgagtctagatcacatctcaagtgtatgatggagttgggggaaaatgatttcttaccaagacctggtatattagtcaaggtaagtattgctagctgctataacaaacaatcgtgaaatcccagtcccttaaaacaggaaacatttatttcttgctcacatcataggtctgaggcaggttgggtgcctctactgagcagccctgctgcgagagagactgtggaatccagtctcctatcttgtgattttaccatcttagacaagtggcctccatggctactgaggaaagagtagagagagaagtggagaatcacataggctaaactcacattccaatggtcataactcagtcagtatagctgtaacctgacaagaccctgaccaataacgttttgctttctgctatcatcatatgggcctttcttcagtgctctaagtatgcaatttttcttttccttctgggcctttgaactttcctttacccgtcttggggcacttccttgccatatcccaataacccacgtgcttttcaccagcacagcaagcttccaaggaatgtttcttcagttgaactctatcatcttgtcaaggagttttttacacgttgttcatgttcacgggaatgtctagaaagacaaattctgattatctgtgtctgagacattttgctagtgcaaagtcaaccttcatcatgatattatgatttatgtggcactttttatgctttataaaactgtttttaattgataaaactaagcagaaatgtatttatagacagttgtttccagagtttcactgttactgaaaatgctgtactgaataagggtgtatttttaatctgcattccatgcttatagctatataagctttatgaagcttatatagcttcataaaatgtattataaattcttcaacataatttcatagttaatagtttcataattaatagtacctgttggtagtatctttcatatgccagctgaataatcattatcattgtcataatgcttaataacaacaataataattgatagtagttgttgtgtacatgtatatgtgggtactggcctatgcttttgatatgtattatttcatttaaacttcattgtactagtcagggctctctagagggtcggaactaataggataaatgtataaaggagagtttattaagaagtattaactcacacaatcataaggtgaggttccacattaggacatctgcaagctgaggagcaaggaagccagtctgagtcccaaagctgaagaacttggagtctgttgttcgagagcaggaagcatccagcacaggaaaaagatgtagccttggaggctaagccagtttaatatttcaactttcttctgcctgcttttattctggcagcgctggcagctgattagatggtgcccacccggattgagggtaggtctgcctttcccagtccactgactcaaatgttaatctcctttggcaacaccctcacagacacacccaggaacaatactttgcatccttcaatccaatcaagttgacattcagtaataaccatcacaagtccaccccttgtcaacttgaacccatacacatctcctgaaatcatacataatcttcaaataaagacaataagttcataattacacataacataatacaactatcctttgtacaaccagaaatgcaccaatccccaacccaagtgctatcacataaagtaataacacttaaatgctgacatgaaatcaataaatcttatgtcacatgataaaggagaaatgaatgaaatgaagatattttcttagtacaagtgtatacatgcacaaacatgttcttaacaaaataaagaggaaatactcatgacaattacactcctcatttctgcaactggtcatatggtcgtagctggtattgatgactaccttcttctactacccattctgtattccctttgccttcagcaagcacctcagcaggccatggttttttacttggtgtagtgacccaaaccttcagtcctgaaggatctgggctatttgtagtcctgcctggattgtgttcttctagtttcccattgaccttaatcacgtcacagggcatggtaatactaaaagacactctaagggatctcctgtattccacacatattcttccttacctccattttgaagtagtggactgatttcatcttgatagtccaggtcagtcaccccaaccaaacactgtaactcccttcttagcctccctaacttaccttctaaaggtaggaggagctcaaaatatccaggtggcaatcttaacttccagcttaatagaattgttgcattcttcaatactttgcatccttcaatctaatcaagttgacattcaatattaaccatcatattcatcctgatcctgttctgttaaaattatcattatcccagtcttacaaatgaggatgctaagaccctgagagaccatgtgatcagcctgtcgtcactcagccagcaagtagtggaactaggctttaaagtcaggccatttttagtttcaaaagtctcactcttttcatctttccacaccatgtatggaaagaatactgagtgagacaggccccaatcagggctctcttaatttataaactgtgtgatctctggcaactcacccaaccctcccttatcttagcttccgtgattacagtaattgtgattgtgtgttccacaccactgcaggacgataaaatgcaacaaggtatgtggaaactttgaaaattccaacatgctgtacaaatccaagggataatcagaagattattattgagtcacagattgactttgttcgtcgagcagactcttggcaaatattaaggatatgcccagagcactcaaatctccaaattggaaacaaagcaatcatataattcctcttataaaatatagcagtgcgactgaaaatgtaagggcccctttacatctctaatgttttcacgaatgttggaggaaaatcattaataaagttgttaaaacaaatactttctggagtatttgttgaaatagctctgtgattcatctttgattaatgtatttacaggctacttgatggacttgttcatgtgctagctctgggattccactgaactccacattctagtcttcattcttttgaaaacatattctggcacagagccgtctatggtgggctgtgtaggtcaagaggtcagggttcaatccttgccttcttgcgagtttgccttgtgatgtcatgcaagttgtcttcctctccatgccttcttttcatttataccattgagtggatggattggacaagatgatacttgatacaataattccccagtgtagttgatattttgaatcatgtgtaggtgttgttaaaataaaaaaattctgaaataaggccacatacctgcaatcaactgatatttgacaaagttgacaaaaataaacaatagggaaaggacaccctatttaataaagggtactgggaaaattggctagccatacacataagaatacaactgaactcctatctctcatcataatcaaaaatcaactcaagatggatcacagacctaaacataatacttgcaactataaaaatccttaaaaaaaaaatctaggaaaagcttttctgaacatgggcctagtcaaataatttatgatgaagaccccaaaagcaaatgcaacaaaaccaaaaatagacaaatgtgactttatcaaactaaaaagcttctgcacagcaaaagaaaaaaatcaacaaacagacaacagaacgggagaaaatatttgcgaattatgcctccaacaaagaactaatagccagaatgtacaaggtactcaaacaactcaacaagaaaaaaaaataaagagctacattaaaagtgggcaaagggcccgagcacccgtaggtcggattctctggataaggcaccggaagtgaccgcctcgcggctgcttcctctcctggagtccagagtctcgctgttccgccgcgatattcagtaaaccactgggagtccggcagcatgaaggcagcgcgccctcccatgactgcagggaagttcatggtggtcggcggcggcatcgcgggcgtcacttgtgcggagcagttggctactcactttccatcagaagatattctcttggtaacagcttctcctgttatgaaagcagttacaaatttcaagcagatttctaaaatattggaagaatttgatgttgaagaacaatcaagtaccatgttagaaaaacgctttcccaacatcaaggttatagaatctggcgtaaagcaactgaagagtgaagaacactgcattgtaacagaagatggcaatcagcatgtatataagaaactctgtgtgctggagctaaaccaaagttgatatgtgaaggaaatccttatgtattaggaatccgtgatacagacagtgctcaggaatttcagaaacagcttactaaagctaaaagaataatgatcttagggaacggtggtatcgcacttgagttagtgtatgaaattgaaggctgtgaagtgatttgggccattaaagataaagctatagggaatactttcttcgatgcaggagcagctgaattcttgacttcaaagctcattgctgaaaaatcagaggctaaaattgcatataaaagaaccagatatacaactgaaggaaggaaaaaggaagctagaagcaaatctaaatcagataatgtaggcagtgcgttgggaccagattggcatgaaggcttgaatcttaaaggaacaaaagagttttctcataagattcaccttgaagctatgtgtgaagtaaagaaaatctaccttcaggatgagtttagaattttgaagaaaaagtccttcacttttccaagagaccatacgtcagttacaactaatacagagatgtggcctgtctatgtggaattgaccaatgaaaagatatatggctgcgatttcattgtcagtgctacaggagttacaccgaatatagaaccttttctccatggtaacagttttgatctaggagaagatggtggcctgaaagtggatgatcatatgcacacatcccttcctgatatctatgctgccggtgacatctgtactacatcctggcagctgagcccagtctggcagcagatgaggctgtggacccaggctagacagatgggatggtatgcagcaaagtgcatggctgcagcgagttcaggagactctattgacatggatttcagctttgaactgtttgctcatgtgacaaaattttttaactataaggttgtactgctgggaaaatacaatgcacagggcttaggttcagatcatgaattaatgctgagatgtaccaaaggacaagaatacatcaaagtcgtcatgcaaaatggacgaatgatgggagctttcttaattggtgaaactgatttagaagaaacatttgaaaacctaatcttaaaccaaatgaatctttcatcatatggagaagatctgctagatccaaatattgatatagaagattattttgactaaaaatggaatttcttcaagaatcatataaagttccaaatgacaccagaaaaatcacaagtcaataaaatgaatgactgtattgagttaatgatgaccacactgaaaattacagaagtgataatgatattagtggaaaaatataaaaacataaattctaagtttgaaatcagttcaaagtttatttatagatatatctttccaatacaacactgaccacttggataaaaatcttaagttatttatttctgtgttttaaacataaatatgtttacttgtgatttagctttggagcaaatttaggtaagttatctatttagccaaatgtactctagtagattagaaccattctttgtgaaatgtcaaaatatggctgtggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtcgaatgcagcccaggacagctttgaatgcagcccaacacaaatttgtaaactttcttaaaacttgagatttttcttgcaatttttttttaagcttatcagctatcgtcagtgttagcatgttttatgtgcggcccaagacaattcttcttccagtgtggctcagggaagccaaaagattggacatccctgatctacatatttaacttaaagtatcactcagtgagcctctgtcagtgtaatattgctttcaaaaagatagttatgtcaaaagaaaaaatatagctaagtatataaaggcataaaaaacttaagacaattatatggacttattctcaaatattttacattttttgtaaactttcttaaaacatgagatttttcttgcaattttttttttaagctcatcagctgtcatcagtgttagcatattttatgtgaggcccaagacaattcttcttccaatgtggctcagggaagccaaaagattggacatccctgatctacatatttaacttaaagtatcactcattgagcctctgtcagtataatattgctttcaaaaagatagttatgtcaaaagaaaaaatatagctaagtatataaaggcataaaaaacttaagacaattatatggacttattctcaaatattttacaattaaagggttttacataaaaatttttcccttgttttatactggaaaattatataatcgtgatctctaattttcaaacattctcaaaagtttagatcttcagagataagctctgaaaatatagatccatacatataaaatatctatgaaattcttttaaaaactattgtctaactacaaaaatagtggcatatacatgcataaaccatctttaattagaaaatttagtaacattcatgtcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctacaaaaaaaaaaaataacaaagcaagcaccttggtaaaaatccagctattcagttttctcatgagattaaatatttcaaaatattctttctgtatcagttggctttttaagtatacaggggtctagttttttatctacaaatttctattcaaatatgagctctattttgaataaaaggggctacattgtgagagaagttctaaagacctcaaatgtccttagacacaatggcacttgacttgacatgcttttgcagacttgatagtatttggtttaaaacagtggtttctaaccactggaacagcagaaacagacttctcaactattagtaatcacaaccaaataagagcagagtgcataacaaaattagatattaaaacagagtcctcccattccaagaaactggaaacccctagtttatgttaaaaggccagtctaaattctttcacttatatctttacagaaaactatattttctctcttccatacccagaaatctaatcagaaaactgacttttctcatgttcaactggacctaggggaatatgacagaaaagcatcccataggctttaatatactttttaaaatatataaaactgaaaattaatagccatttaccctgaaagagttctgtgtggactttgtcacttgcacagtaatagcatgtgcctcattgttcagaagattagctttaggtcctattttcaaataagaaatggtagcataagctgtaaaactgtagtcttctctgcagaaaatgccaacaataagaaagcttttgaaggaatcacggaaaacaaatttataaaagcaataactatatgcgcagtaatttttaatacattgacttgaaataataaaatttacaagaatgcaaataaagcctttaaagaaaaaaaaagtgggcaaaggacatgaacaaacatttctcaaaagaagaaatagaagcagccaacaaacacatgatataatgatcagtatccctaatctttggagaaatgcaaattaaaaccacactaagacatcatcatacaccagtcagaatggctattattaaaaagtcgaaaaacaatagatgtttgtgtggatgcagagaaaaggaacacactgttggtgggaatgtaaattagttcagcctctatggaagacggtatggaaatagctcaaaggactaaaaatagaaccactgtttgacccagcaatcccacttctgggtatcattatattaaaaatgacacctgcacttgaatgttcatcacagtacctcacaataggaaagtcatggaaccaacctaagtgtttaccaactgttgattttattttaaaaatgtggtatatgcatgccaagtaatactatatggccatgaaaaagaatgaaatcatatcctttgcagcaacatagatggacctggaggccattatcttaagtgaactaactcagaagcagaaaatcaaatatcacctgttctcacttataagtctgcactaaacagtgggtacacatggacataaagatggaaatagtagacagtgggtactccaaaagcagggaaggcaggagggctctgaggaatgaaaaattacctcttgggtacaatgttcaatatttgagtgatgggtacaccagaagcccaatcctcaacattattcaaaatacccatgtgacaaacatgtacatgttccccctgaatctacatttttttttcagaagaaaataagtgattgtttttatttttaggaaactaaacaaatatcattttcttctctctgatctcatagcacttgacaaacaacagggtgtagcagtccaaaccctggcactagaatctacattttttaaaaaaagtaacaattacaaataatatcttctgtatcctattccctattctccctcttcctagaatacattccaatgccttcaactattattttaatcacaaaattgttgatgacaaattgtgatattcaaatgtctttttttcattaatagaggtattactgtataacctgtgaaagaaatgctttactttgataagggaaaatgatgagtacaggagttaaaaaatattcttcttaaactctagactttttgagaccaaacctcttggaatttgtattacttattcaaattgttcagctggaggctattatcctaagtgaattaacacaagaacagaaaaccaaataccgtatgttctcacttataagtaggagctaaacgttgagtacacatggatgcaaagatgggaacaatagaaactgggtcctgcttgagggaggaggctgagaggagggtgagggtcgaaaaactacctgttgggtactatgctgtctacctgggtaataaaaccatttgtacaccaaaccacagcaacacacaatttacccatgtaacaaacctgcacatgtgctccttggacctaaaataaaagttgagaaaagaaaaataaataaacaataatagtggaaaaattcataattttacttctgtgtcatggtcaattaaaattttaatatttagcaaagcaaagaaaaaaattgttcgtatggtaatgtaaaaagataagtcttgaatttctacatgaatcctaaaatttgcaaaataaataaaactaagtttagcagctctctgtatttctttagccatagactaagcaactgttctattattcctttagaaaattccttttgtactcaaattttcttaattctgcttatgcaacagccaggattctcagtatgtaacagtgggttttgccaacttgggtcccagcctaaattctagttatttgttttaaatatttaatgcaagtcagccagaatgccaaaacactatccttattactaagcaatatattaaacaaacacccctgacttgttcctcacccttaatccacagaattgaaacgaggaatggaagaacaaataaattttaacgtaaaataataataatttaatgataacataaaataatacacaaacacataataataattggatgttagtcttttttaaggctttatcagaatattctgtgttaaattggctgggtcagaatggccaataagattttacacatccaaatggctctctattacactgaggaggtttcgttcattcctgtgtgacactgtgttagtgctttgtgcagaattgtttttgtaatatttccttgaaaaaagtgtagaattttctgtctttgcagaacattgaatggtggtgctatatatttattatagcttcttgaagtgtagttatatacaccagatatgtagaaatagaacccacatctcccatgggatgtgtgaatgacagtgtggtgacaaaagcaccccaggggttcaggctaactgttggttttaaagcaaggaaaacttttagttctgtgcctttaatgtgtatgatttactgattgtgtgtatgtgctgaaaaataaaatcattttcaccctgtgggaaaaaaggcagtttgtttgtgtaaggtattaaagactgcatataaatttaatattctccacatagcataaaatttaatgcttgttaagtaaaattgaataaagactctaaaagcaaaacataaacatttcatatttggaaaatttgcacaacagaatgccaaaatatttgttgatgttcttctttcaactataaagcatagacgtatttcctttaaatattatatgaatcctgctgtgatttaaaaagaaaagtggcatctaatcatggaacattaaattgacttggttatgtagtttatggcttatttatcaaaaaagaattcaaatccatttttagaatgaatttctgagatttaaagaatagaaatgaaactaaatgcaaacacacaagaaaataaaaaagcacagagataaattgtctaaaaggctatatttttggtatttttgtttatttaatgaataaacaatatgaattatacagtatctcatctcaacaaaggcaacatttcaatctattgaataaacagtagcataattagccttgagttaatatcccctcctcacacatacacttttctatggttcacttcagtaaaaaggcaaatcttttctgctttagttcctgcatatttagagtgcttaggctaggccaggtgcagtgggtcatgcctataatcccggcactttgggaggctgaggcgggtggatcatttgtgtcaggacttcaagaccagtctggccaacatgtttaaaccctgtctgtactaaaaatacaaaaattagccaggcatgatggcatgtacctgtagtttcagctactcaggaggctgaggcaggaaaatcatttgaacctgggagggagaggttgcagtgagccggtatcatgccactgcactccagcctgggtgatagagtgagactctgtctctaaataaataatattttttttaaaaagtgcttagcctagtactggctgctcactaatcaaggtagcgtgtgctgaaggttgcatggctgtgacaatttcttaaggaagaccatagtattggtaggttttagatattaagtaaatatttttaaaacaaataaatggttattataaatgcagacattaggatgatatttttttaaaaaataaatagccctatgggggaaagttggttttatttcaaagcaccttatttttttggaataattgtgtgttaagaatcaaaacacacatacacatcgaatgattaaacaaataagcaaggaaaacaaataagcaaggaaaacaaacttcttctacattatttttatttatttatgttttaactgaaagtttgtgttctttgatcaacatctcctcaatccttccatatcccagcctctggtaaccaccattttaatctctatgtctatgagtttgaattttatacttcaaatataggtgaggccatgcagtatttgggtacttgtctttctgtacttatttcactttacataatgttcttcatgttcaaacatggtgtctcaaaagacagtattttttttcttttgtaaggctgaatggtattctctggtgtatccaggcacacctcagagatactgtgggtttggttacaaccactccaataaaacaaatattacaagaaggcaaatcacacaatattttttgctttccagtgtatttacagttcttttcacactatactgtagtccattaagtttgcaatagcattatgtctgaaaaatgtatataccttaataaaaaaaaactttattgctaaaaatgctaatgattatctgagccttcatcaagtcataatcttttttgctggtggagggtcttaccttgatgtaaatggctactgactgatcagggtagtggttgctgaaggttgggtggctctaacaatttcttaaagtaagacagcaatgaagtttgctgcatcgattgactcgtcctatcacaaaacatttccttatagcttgcaatgctgtttgatagcattgtattcacagtagtattgctttcaaaatttgaatatgtcttctcaaactctgtgctgctttatcaactaattttaggtaatattctaaatcttttgttgtcatttcaacagtgttcactgagtcttcagcaggagtaggttgcttctcaagaaaccactttctttgcccatctgtaagaagtaacttctcattcatttaagttttatcatgagattgcagcaattcagccacatcttcaacatctaattctagtgctttttgccatttctactatatctgcagtgataccctcaactgaagtcttgaagctctccaagtcatcaccgagggttgaaataaacttcttccaaactgttaatgctgaagacagcttctttaaacctcatgaaccatcctctgctaccttcaagctttcttctgcagcttcctcacctccctcagccttcatagaattagagatctaaggccgcctttctctggattaggctttggctaaacagaatgtaatggctgatttgatcttccatgcatactactaaaactttctccgtatcagcaataatactgttttagtttcttatcatttgtgtgttcaccggagtagcattttttaaaatttccttcaagaacctttcattttcattcgcaacttggctcactgacttaagaggtgtagttttctgcttatctcagctttcgacatgcctttcttactaagcttaatcatttctagcatttgatataaagtgagagccctgcaacttttcttttcacttgaacacttagaggtcattgtagtgttattcattggtctaatttcaatattgttgttctcatgtgatagggagctctgaggagagggagaagaactgggaacagctcgttggtggggcactcagaacacacacgatgttgactgattaagttcactgtcttatacgggtgtggtttgtggtgccccaaaacaattaccatagtaacatcaaggatcactgatcacaggttaccataacacatataataatgaaagagcttgaaatattatgagaattgccaaaatatgacacagagacatgagatgagcatatgatgttggaaaaatatcaccagtagatttgttcaacagaaggttgtcacaaactttcaatttgtaaaacaatgcaatatctgcaaagggcaataaagtgaagcacaataaaatgaggtatgcttgtatataccacaatccataccacaattatccattcatctgttgatggacacttaggtttattccgtattttggctatagtgtttaatgctgcagtgaacatggggtgcagattactgtcatttgatttcattttttaaatatatactcagtagtgagattgctggatcatatagtaattctatttttactttcttgaagaatgttgatactgtttgtcatcatggctgtactaatttccactcccaccaacagtgtacaggggttctcttttctccacattttgctggtactcattatttttcatcattttaatagccattctaacaggtatcaggtgatatctcattgtagttttaatttgtatttatctgatgattagtgatgttggacatttttttcatatttctcttggctatttgtatgtcttcttttgagaaatgtctgtattcaggccttttgcccatttaatttggttgttttcttcttagtcagttgagttctttatatattttggatactaaaacccttgtaagatatatggtttgcaaatattttcccctattctgtatgtcgtttcttcacactgttgatgtttcctttgctgtgctgaagctttttaatttgatagaatctcattgatctattctcatttttattgtctgtgcttttggggtcatgtccaaaaaattgctgttcagagcaatgtcaaggagcttttcctctatgttttcttttagtagttagtttctagtcttaaataggaactattggaactaaagttataggagctatttttgctggaggtcctagtgcaaatactccaagcttaaaggataaactttgcataatggtaaatcttgggggcaagatgacatctatcaatatgttttaaggaaaattcatattgtgattgtttaatttgggccagatataactgtcatttcatatgcttcatcatatcccagctagaagatgaatgttagaggacaaatgaattatttcgtcattaacttagctgatgtaatctttaggaaggggtggaactgcaccacatttaaatgttccttccccttttattttctggaagacactgacaaaatggtgttaattctttttcaaatagttgttagaattttccagcaaaactatttggcctgaagatttttttttcaaaaaactttaaattatacatttcatgtttttaatggttataaaatgattcagattatcagtttcatcttggttgagttttggtagtttgggtttttttcaagggattggttcatttaaactgtcaaattttttaatgtaaagctgtttgtgatatccccttattattcttgtaatgtctatattatctatagtgataacccctatcttgttccttatgttgatttttgtttacttagctgtcattttcatcagtgttgctagactttactgattttattgatgttttttcaaagaaaccatttttttttgctcattttctttattgttttcctgtttgtaatttcattgattacctctcttatggtttttgtttcctcccttctgcttgctttgggtttattttgctcttatatttttcttttctgaggtagacacttagattattgattcgtgatttgttctcgccttgattataagcactctcttcactgctttggctgcatgctacttattttaatatgctgtatttccattttgatttcattttatgcaatttaatttctgttaacaattcctcttttaaaatgaattgtgtagaaaagtgttgtttcattttcacattgttagggatttttctgttgtctttcagttattgacttctagtattatttcacctagttaacatactctgtacaatttcaacttttgaaatttattctggtgtttttttatggcctaggatttggtcggtatatgttccatgatctccttgggttttttttttttttttttttttaaagaaagagtattctgctgttgttggattgtcaaattattttagatattaattagatcgtatttgtagattttgttgtttttgtagattttgttgttaaggtatcagttttctgtggctactgtaacaaattaccacaaacttggtagcttaaaacaacataaatttattctttcatagtcctgcatgccagaagtcaaagtgtcaaaaggaccatgctatctccagaggctctggggtagaatccatttcttgcttcttctagctttttgtggctgctggcaggtcttgaggtttcttggcttgaggtcacatcactctaatctatgtctctttcttcacgtcaccttctcctttgtgtgtggtgtgtgtgtgcgtgtgtttgtgtgtctgtgtgcatgtgtggtctccctctgccttcctcttgtgaggccactcatgacgatcaaagtatcagaatgtataatattatcatatttgtctcagtcatcgcatatgatttagacaactcatgaggagaagataatctatgtatttacccatacttctagtccttctgttccttttcttccttcctggtgctcaaagatttttttctcttatctttttctttctgtttaaagacctttctttagccattcttttttattattattattatactttaagttttagggtacatatgcaccctaaaatgtatcttggagtgaattcctttgagtttatccttatttagaatccatatagttgaatttgtgggtttatgtctttcaccaaatttaagacattttcatctatagtttattcaaatactatttcaacctcactctcccctatacttttggaactcttaggatatgaatgtggatttcttttttattgtcctaaagatccctaaaactttttttcagcctattttctctgttgttcagattgagtaaattctattaagctgtcctcaattcactgattctatcctctgtcatctccattctaattttgagcccacccagcatgttttctatttttgttgctgtatttttcagttgtataatttacattggttatttttatatttctattgctttactgagattttgtgttttaaaattcatttaaaaagaatttataattgctcgttgaaatattttcttatgccctctttaaaattcttgacagataattccaacatctgattcattttagtgttggcgtcaatcgattgtcttttctcattcaagttgtgattttcttggttcttattatgattcttatgatggttgactttctattatatttttgataatttgggtattgtgtttgttaggagactctagattctatttaaaatttttattttaacagtcaattcctctatttaggtttggcatgtaggtcctggcctacttttgtgggttttagttgcaatgactgtgtaattttcagaggttatgtggtgctattttcatcttggtttatttcatgcctcatggctcccactgtccttggtaatgctgcttgagggtgcagagcaagcttctccaggtcagatatccttatgtctctatatggaggggatttttcagcccatgtggatgaagagtaattcctagctgggcatttgttgtgcaaaattactcttgctggtgactctagccatacaatttcttgagtagtgagttatggtgggtgtgagagggagaatatcaggacattaagaacatggaagcttctcagactgggcactgtctcctgcttttttagctagagctagttctttgaaagcaaatgttgctctgtgagagcagtggcccttctggaagcccctttaattattgaagcacccgggacatatcattctgtttgtgctttcataaattacattgcagggatctgaaagaccagaaaccaaatctagaagtgcccattttttgttactgaactgaattctaaagaatagtcatgcaaatctatatcagcagctacatctatatctgtagcaacaacttctctcttttcaactgcccattgtgaacatctctttaaggttgttttgccatcacattgatttatatttaaaattgtaattgcttcgcttctctctccttcaccttcaggcttctacagtggttaagagtgtttcctttggagtcagtccagtttgggtttgagtgttgaccttactgcttattagcttgtattctttacaaatctcttaacctccctaaatcttaaaactgaggatagtaatagctagcaaaagagtaaaattcagtaacaaagtataaattaagtattaattaagtactcagcacagtacatgggcaatagcaagtactcacagatgtgttgagttagctacaggcatcatcctcctcaacatcattatcatcttttccagtttatagataaggaaaccgaggctttgaaaggatagggaactgaacgtaggtcagttttcccacttaattttcaggagagttgaaattcaaattcagacctgacttcttccaaatccttcttttcaaactattatgtaacactgcatcaaatgattttcttataaaacctgaagctccatgagagcatggattaggccatgctcaagataggcaaaaatataaaacatgtaatgtgcagttatatgacctggacttactcaattctgattacttattgataacagtggtgaatattttcatagaactatctgagcattaacatgcaacaaacccccatgagatgaatttacctatataacaaacctgcacatgtaccccccaacccagcataaaagtaaaatgaaaaaagaaataatgaagatagtttaacagaacctgacaaccaaggtttgtgatagtatgatatttaaccctttactatagctcagagcaaaatactcccctttgttatgcttgccaatttctgaaatctgacaaatgttatgacaatttatttttcttatgtcttctgtgctatctcattgaaacttcaatatgatgtaagatgcaataaaaccttagatagatgtttatattttaagcaattttccacaattcttttatatacaaatatgtagttcttataatagttttgcttattgctaagttaataaatgcaaataatgatgaatttctgaagttataattatgagaaacataattcaagaaggataatttatattattttccaattaaagtaaaaatgcattggtgacagagatacaaatggtgccattgaatctgcccatttattaaataaaaagttcactgatagaaaatattgaaaaggaagttatttactttatttctttgggcttatcgtctatgaattgtttttctgtagtgtaggcaatcaacaacattttcttccttcagggtctgtttatgtagagatttcagaaaacaaactaatggccacatataagtcaaggacatatttgctattttacatttttgagacaggaatgtgaactattcaatttagactttttataaattaatatttaaaatgcattacatataggaaataatatatattaatttatgcatacatacatacactaattccacatttaaaattaagatggagatgataaaggcaaaagagaataaggtctagttgtgatggtaaatgttaaagttgatacctaggaagaaaagagaaagaaaaagaaaacaggaaccaatggaaaaaaatgagagtagagtccaagcgatgaagaagagagaccagcagaaggagagacaaacaccaaataaagagaggagggtgaaaaaagtgtaactccacgaagcaagggagaagaaagaagaaatcaagatggagaagaaaaaagaagtaattggaaagaaatgtgaagagagagagagagactacatagaagtttaaatatatgagtatcagatgttatcattgccatttaaaaatatgattaactctattaagcttatcaaggtttttgcgcttatgtcaatcttaaaaaaatttatataataatttttaaactatgggattgtacattatgtgtttcttccttaccatgcccttaagatcctaataacaagaaagtatgtattattagcaacactcctaccctaaagagcatatgaaacatatacaaacaatctgtaaatattttacaggacaattattttctttttactcaaaccataacctgtagtattttgagagcctattttaggtagtgaatttagaatgtcttcctcctcctattctctggccgatatagatttggttctccaccatactgtgatacgtttgaaaaggggaactgtattttatctttctatccttatcatccagagcagagcattactagtaaatagaaaataatcaatattttagtgaataaataagagtaatataaataaaaggatgaaatactgaactttagcagaaattttacataaggtaaagtgagcatttaattccataaaaattataacatcaagcaagattccattttattttcttatataaacaagatcttggtgaatggtacaagggagaaaagtaaaaatattaatgacttaaaaatccagatcccaatagtttattccatatttgttcagtgccaccagtttttatcaactagcttaactatttagctataaagaaaacaggaaaatacatgtattgagcacattccatgtagtagtggaacatagatgaaactgatgcacagtcccaactggtcaacttttagcctattctttctaagtaattgcaactggctttttctccaggtgtgcttagtttaaccttagtccaatccaaatagttatagttgtagccataccccagctccaccttccttttctactggtgttcattgttcatgccctctgaaggtgttcattaggctactgggcataagcttgtgttcactaagtttcccattaaatctcagttccctaaattctccagtgaaagggcatagaaaagaggaatagatttaaattactttaccctcagattctttatcatatgacccaaattcctttagtattataattattattttttcatttatttttagcttatatgaacatgctagttgagtgatattttctgataatgctagcttaatatctggtttatatttttatttttaagaataagagaactgtccactaacctaacaagtgcaatgactagtacattttaaaagtactataatagttgaaaaatgatttacataaggccaattactttgattcattttaacctcctggatttattttctgaaaggggtattattttaatgacagttaaatatagttattttgacagatggatttaccatattttcattattatttagtaggctgaaagcttttgaattggctcataaaccagtttcatgatgtaccttggagtatcatcttgaataaaaaatgttttcctgtttcatttttcactgatctcactttccatttcattattgtctttagaaagtagctgagtgagatataaaacaattgtttctcttcagaaccatgaattttaaactggctgaaaatcagatttaaatttgcttatatgaatgcagtaactcagtattgctaataaaacattttttctttctattcatcagataatatattaaattttgtgaacctactatgtgaagagtactgatcaaaattccatgttaatttcacaggtgatggaagtcaaaggacaaatgatccatgttccagaatcaaattccattttatttttgggctctccatgtgtggacaagttggatgaactcatgggccgagggctacatctctcagacatccctatccatgatgccacccgagatgtcattttggttggtgagcaggcaaaggcccaagatgggttgaagaaaaggatggataaattaaaggcaactttagaaagaactcaccaggccctggaagaagagaaaaagaagacagtggatcttctatattctattttccctggtgatgtagcccagcaattatggcaagggcagcaagtacaggccagaaagtttgatgatgtcaccatgctcttttcagacattgttggcttcacagccatatgtgcccagtgtactcccatgcaagtaatcagcatgctgaatgaactgtacaccagatttgaccaccagtgtggatttttggatatttataaggtaagggagtttagttacttacatataaatgttttttaatagtaaattgtcatgtgaattaaattgatttttttacttaaacttgatactaaataattgacaactctttaatttagaaattttatagataatacaggtatttcttctttatgagtaaactttcaatatgagttcgtttgtgttgacatagataactgtgaagaatcatgatattgctcagtaaggaaaaattctatatagctactcctctaagtttatttttattaaaaaattaaacttgttgaattctaggtaactttttaccacataattattcttgcttagaaaatggggttccaatataaactaagaattttattttgacagttaaaaacaaatagcaagttatattaaaatatgcattgtattgtcaaatatggctaatcagtattttgcactgcattattaagtgagatctctttaattctaaaaaaacctatatataaatactctagctattgctcaaatgactaatgagtttttgaggaagtaccttaattttccaagctacataatggaaaaatttccaaaattggtgccaaccaccatggttggtttgatttggtgaactccttattaatttcttactaagatcatagcaatattttgagtcatttagctccatatctacctaatcaataactctacaactttacctagaatcttacgtagattgcacaatgtcagggcatagggctttttttatatgaagggaatcaagtacttttagtataaatagttgtgagctgcaggttttattttcttctttactaatacatattgaccagctacttatttttacagtatgatcttcacataagcagatttggaaagaacttgtctgattcactttgtaaattttatattatcatccagaaggtgtttttatgaaggtgtgtcttcttggggaaatgagctctttagtttcattatgtagactatgtagccaatgttaaatattttaattgaatctcttctgagtggtaaacattcagtatgaagtatgtataagggattttccttgttacagaaaattaagttcttataaattatctttaactcccttataatttattggtatataatttacagcagtggtagccaaatgtctgattctaaaccggagagatactataatgttaaactgtcacttccaggacagaggagatcagctgaatttggcatcactttccttcctccatacttggggcactattacaccaatctctgccacaaccaatcttttccctctaaactactgatttgcagtgtttgcttcctccagttaaagcagtcatgttttttttgttttgttttgttttgttttagccctaagttcatacaactaaatgagaatgataatagataaataaattattctctggaaaaaacatgggaatccctgacaaacataagtatcagttagattttgagaaaagaagaaatgtgatgcttctgagtatgccaaaacaggttcaaggttttaaaatatgatttgatttcttagacatcaagcattcattcccttgtgagttaggacatctcacagaaaaacagtagaaatactccgtatgatcttcaaattttcctatatattattaaaccgtggacagtttcatatagtcatgaataataatcaacaagttttaacttacaaaatgtttatataaatatatatatatacacacacacatataataattctagttcacaacttttcttaaactaaacttgtttaggaaattttgcaattaattacaactaaagattccaggccttggtgttcttaacatatcttcaatgctagtgtattaatcagggttctctagagggatgggactaataggatagatgtatatatgaaagggagtttattaaggagtattgactcacacagtcacaaggtggaatcccaccataggctatctgcaagttgaggagcaaggaagccagtccgagttccaaaacctcaaaaagtagggaagccaacagtgcagccttcagtctgtggccgaaggcttgagaaccctgagcaaaccactagtgtaggtccaagagtccaaaagctaaagaacttggagtccaatgtttgagggcaggaagcatccagcacaaaagaaagatgaaggccaaaagactcaggccagtctagtccttctacattcctctgcctgcttttatcctagtcacgctggcagctgattagatggtacccacctggattgaaggtgggtctgcctctcccagtccattgactcaaatgttaatctcctttggcaacaccctcatagacacacctaggaacaatattttttatccttcaatccaatgacgtttacactcaatattaactatcacagctagtaagtacatgtatctaggataggtgtatagggcagctttggctgcttattcaggattagggaggttgagtttgggagatccagactggaaatacaatatatgctaaatccatagcagtaatggtttggccagagagggaaagacaaaatgatattagtcctgtataggataaaaaaagtacattaggagaaatgcattaggagggatataaattagaaaacttctatttgaccagcctgatttgtaatcttcataaacattctagtgtattttctagaaaatacacacagtgctattttaaaccatgaactatttgccagatttttaatggctattgaaacaaagaatcccagaggtggtagaattttttgtaaggaccacaagtcttattttatgaaatgaaaagagttttgctagattgaaagtatgtatagaatttgggtaattatgtagaataaccataccacagagaaaaataaggtacagcccaccttttatgttagaaatgtgaaaggaagccaggtaaaactaaatgccaagagaaaagaactagatggagtggcccacatggggctttcatagtgtgctacgacatgagatactagtctctaaatttgtggttgcccctctcttcttcatgtcattactccatgttttcctatcatcaggcagatgatagagtgaagaattataatttcagtggtagaattcagataaattaagacataatatgaccattctgctaaaataatcaagctatctataaactagagggttgaggaagaagctgtggattttgctgtgcatatatcaagcactgagaaaatgaaagcctttccaatgcttaactgccaagatgttacaggtgtatgaatactaagtaagagctaggcaaattgaagaaagcctgggttataattttgtttctcttgtaattagaaaggcaaattttcagtaaaagtcaacataaacaacatacgtaatattttgcttctcagattgttctcacatgaacataaagaaccagtatctaattttgtaaatcaatggcatataaatagtaacaataataatggcattgactattgaagcaaattcatgtacattttgctttgttttacatttgtctttgggaaagcctttgattttagataagcagggagaaagactttgcctttctctgattccattctgccatggttgcagtgttccagtgctattttaaatacaatctttagcatccccatcttttcacctttaagcactttaacttgacttttctccagttctataccccataaaataaagatattcagtgcatcagtctcacagttacatcataagcatttcagtgagctttcctataaagagttgagaataccatctggtacatagtagtaaatgtaaatattagctgccattagaacttctcagacaggtgtatctatctagacatacagggatgtgtgttatgtgattatgtttgtgtgtgtgtatgtgtgtgtgtgtatatatacacacatacctagtaggcccagagctttttagaaaagaataaaatatgatctcatataatccctccttgaataacatgtggcattatgtacattttcggataagaaaactgagttttggaaaggttaaatccagataatgtagctcacaagtcagaatttgaactgagacttgtctgattctaaagcctatagtttttgtacaatttaggctgtgatctagacaaagatcaaatgatagaaacaaagagtggaaactgtttaaaaatgacatgacagtataactacagttattgattctgtaaagtaggagattctcccgtctgccatcttttctctttgttagaaaccagccagcacctctgtcttcattcctcctatggaaagtggcataccaaaagaggcattgtgggagcagtggtcccaggtgcaggcaataagaggtatattttttaaacagtgaagtggaataaaagttgatctggttttaaaaatcatcttacccaggtaactctaaaaatgttagtgatggccaggcacggtggctcacgcctgtaatcccagcactttgggaggccgaggtgggtggatcacctgaggtcaggagttcgagaccagcctggccaacctggtgaaacgctgtctctactaaaaatacaaaaattagccaggcatggtggtgggtgcctgtaatccaaactagtcaggaggctgaggcaggagaattgcttgaacccaggtggtagaggttgcagtgagctgagatcacgccactgcattccagcctgggcaacagagtgagactacgtctcaaaaaaaaaaaaaaatgttagtgataaaatagttttctctgtcagagtaaaggtagagggggagtattcccatcacagcctctaagtgtggtttgcaaatgtccatggcattaaacattgtcaggtttagattgggaagaaggaacagtaagacaagatagggcaaccaggtaataccaggacccaaattctattacattagggaacctgatgttaaaaatctgaaaaacaacaacacaaagttcatattggcaaggaaatgtaagtattataagcctagctggaaaagcagagttcaggccaattagcaaagtaggaaatccaggctcactcacagggaatatgagtgggcccaaggggactagatgataggaactggaaaccaggcaacatgtctagatagaaagtataaatatgggtatcagtacaaactttgataaagaagcagagtcttttccctggacagaattaagcttagaatcagagggtgcacaggacaagtctacagtgtcaaaggggaactgaatatggcaacctcatcaaacatctgaaaacagatgtttctgacatagagttttagggctacacagctttatgcctcaagaattttgatttgtcttgccacttgataggaagctactaaagccctctcttcttcgctggaccttcagccagcctctagaaaatgcagtagattctcaaggatatcacttcagcatgaaatagatttcacagaaaaatgaaatgcttcacttccaccttgttttgttgcctttcaaagtacttaggtacttaggttattgttggaattttataaatatgtatatgccattttacgtcatttgcagcatgaaatgccagttccatttagtaaagagtaactgcttcatttttccccaagatttacatattttctcttttaatgatcagtgcacacactttttaaattgagcactgtttcagatttatgttagttctcttcagtagtctccatcaacatcaacatcatttgcttttactgatattttgttggaaacaaagcaacaatgttttctaattaggaaataagaatttcttaagtcaaaaatttattcaactcattcattcactcaataaacatttacaactcatttgataaggagccatgacttccatagaacctttaaaatgttatggaaattagcatgtatttttagaacaattttaatgaatagaaaagaactcatttatatgctgtaggaagtaaggtgaaagtcacagataagcattctgttccaatagcttttctatggcaggagttatattgtcagtttcaaaataccataatgctgtaaaaattacctgaagagggtttaacctcatttatacgtttgcctttggcgagcactttggttggagataaggaagaggcaagggtaagatatgtttctttcaatccattcagacaaggctgtggaatcccagtgctatcttgagtgcactagttggatttctcatcattccacctttcatgggttatttaatctctctgcctcattttatcatctgtaaataagagactaattttatcactttatagttttattttgtgagcttttaaatgagatttatgtaaagtgcttaaaacagtgtctccttcatggtagtaaatgtacatattagctattattactttccaaacaggtatatctggtcctatatgggaagcgcgtgtgtctgtgtgagtgtgtgtgttgtatatctgcaggcatttttatgtacataaacattgtgtatccaacgcttactagaaatagataaaatgcttatttatttggatttattcttttaggttattagaattgcattgtatgccaaagactgtgaaggaaggatagagaaataaaaggagggagggagataaatagctttccgaaatgcattatttgtgtcatcttcatggggcctcaaagattcttaaagatgcttccatctgcatactctgaattacaatatggaatttataaagatgacaatatttctgaaagccagaatgactcgtgggatgtctgtgaccaatactatgaaactgaaccccaaatgtctatttttatattctaatacggcagcctgaattatttttcttctatattcagagaacatttcttttagtgttgtggcatattctgaagacagttagaaggctaaaatacttttagttgctaagcagaagttaatattaatgatgtgtcttgctgaatttttcaaagtgttttgaggtttttgtccctatcgatatttaatttctgaagagtggtggcaactgcaaacagattggtgtttttgatttttacaaacagtatgaactgaatatttatgaccccccaaaattcatagttgaagccctacttaatgtgatattatttagaggtagagtattttggagttaatcaagtttagatgaggtcttgaaggtggggacttcaatgatggaattagcatcattataagaagaagtgacttgagcttgctttctttcctctttgaggacacactaagatggcagccacttgtaagctaggaagagagccctcacctgggaagtgaattggctggcatcttgatcttggactttccagcctccataactatgaggaataaattcctgttgtttaagccacccagtctatggtgttttggtatagcagcctgagcagactgaaatcccaagagaaggtatatcacttctacagaaagtgtggaaatttcttcatgatacaagtctctagtaagttctcttagtagattagtccatattgctaggatttcctgtatctaataagaataaatgctaccgtcccattgatgcaaatgaaagattttcattagccttatagagttaattgtgttattgcacagtatctctcttttgtgtatcaataaactgtaaagaatttaagctgtaagctcaaactgctcatttatctttgccactaccacttcagcagaacagtatgaacaacttgcctttagtttatacatagggtgagtttactaaaatggaaattcattttctaggcaggaccgctatctctcactcacctgataggatagccttaatgcaatctgcaaatctcactgaactgaggtgtttctattacctttttaaaacaaacaaacctttaattaatgcttttatgtagtagaaatgctgtaaatacttctgccactatttatcacttaataacagtgatttaaaaagtgaaaatttctgaaagcaaaatgaaactaacagaattcacatttacttgtattctcagtattaagtgcttaaactgtgatatttcacttattttccagaacaatcctgtggaataggtgttatgatgtcccttctgtgtttttaaatttttatttcaatttttgtgggtacatagtaggagtatgtatttatggagtacgtgagatgttttgatacaggcatgcaatgtgtgataatcacatcatggaaaatggggtatccattccctcaagtatttactttttgtgttacaaacaatccagttagacccttttaaaatgtacaattaaattattattaagtatgatggctctgttgtgctatcaaataataagtgtcccttttgaagatgagtttagtaagttgcagatgctacttgaatttagttctgatttagttaaaagctcaaattttagaaagcaatggtttaaatcattcatgtgtcagatagctagtgtttccaattacctagatggagaatcaggacaaaaaaattgttctggcacttacatactataggttagtgcaaaagtaattgtgggttttgcccttaattttaatacataaaatgagatattcatttatcaattggtacggtctctccaacaactttgacaaattaccagagttcatctttttaaaatgaaaacaatagtatgtcacaggactgttatgaggctgaaaagaactatgagccaaaggtccttgttacaaacatgaggccctcaatgtagtaattagaagatgaacatgaatttgtaaattgcaatttgaattctaccctagaggtaaaaatataactaggtttccttttttaaggtattcaacaaatgtgcactatttttgaatatgtgttggatatcataaatacttattctctttggctcccggaggttaaagaggatctttgtacaaaagttaaaagaatagtttcagcacagtagaagatccttaagaaaaaccgtgtttctaacagtgaaatagactggcagaagcatatgctctgatcacaggagtgatatgccacaaccttttggtggagcaggtaggaacaactttcagtaggtcccctgattctatgagattcttttttttttttatactttaagttctagggtacatgtgcataacgtgcaggtttgttacatatgtatatacatgccatgttggtgtgctgcacccattaactcgtcattttcattaggtatatctcctaatgctatccctcccccttccccctaccccacgacaggccctggtgtgtgatgttccccttcctgtgtccaagtattctcattgttcaattcccacatatgagtgagaacatgcggtgtttggttttttgtccttgcgatagtttgctgagaatgatggtttccagcttcatccatgtccctacaaaggacatgaactcatccttttttatggctgcatagtattccatggtgtatatctgtcacattttcttaatccagtctatcattgatggacatttgggttggttccaagtctttgctattgtgaatagtgccgcaatgaacatatgtgtgcatgtgtctttatagcagcatgatttataatcctttgggcatatacccagtaatgggatggctgggtcaaatggtatttctagttctagatccttgaggaatcgccacactgtcttccacgatggttgaactagtttacagtcccaccaacagtgtaaaagtgttcctatttctccacatcctctccagcacctgttgtttcctgactgtttaatgatcgccattctaactggtatgagatggtatctcattgtggttttgatttgcatttctctgatggccagtgatgataagcattttttcatgtgtctgttggctgcataaatgtcttcttttgagaagtgtctgttcatatccttcgcccacttgttgatggggtggttcttttcttgtaaatttgtttgagttctttgtagattctggatattagccctttgtcagatgagtaaattgcaaaaattttctcccattttgtaggttgcctgttcactctgatggtggtttcttttgctgtgcagaagctctttagtttaattagatcccatttgtcaattttggcttttattgccatagcttttggtgttttagacatgaagtccttgcccatgcctatgtcctgaatggtattgcctaggttttcttctagggtttttatggttttaggtctaacatttaagtctttaatccatcttgaattaatttctgtataaggtgtaaggaagggatctagtttcagcttcctacatatggctagccagttttcccagcaccatttattaaacagggaatcctttccccatttcttgtttttgtcaggtttgtcaaagatcagatagttgtagatgtgtggtattatttctgagaactctgttctgtaccattggtctacatctctgttttggtaccagtaccatgctgttttggttactgtcaccttgtaatatagtttgaagtcaggtagtgtgatgcatccagctttgttcttttgggttgtcttggctatgagggctctcttttggttccatatgaactttaaagtagttttttccaattctgtgaagaaagtcattggtagcttgatggggatggcattgaatctagaaattacctcgggcagtatggccattttcatgacattgattcgtcctacccatgagcatggaatgttcttccatttgtttgtgtcctcttttatttcattgagcagtggtttgtagttctccttcaagaggtccttcatatcccttgtaagttggattcctaggtattttattctctttgaagcagttgtgaatggagctctctgtttttctgttattggtgtataagaatgcttgtgatttttgcacattgattttgtatcctgagactttgctgaagttgcttatcagcttaaggagatttggggctgagacaatggggttttctaaatatacaatcatgtcatctgcaaacagacaatttgacttcctctcttcctaattgaataccctttatttctctctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttggttttgtttatatgctggattacatttattgatttgcatatgttgagccagccttgcatcccagggatgaagcccacttgatcatggtggataagctttttgatgtgctgctggatttggtttgccagtattttattgaggatttttgcattgatgttcatcaaggatattggtctaaaattctctttttttgttgtgtttttgccagcctttggtatcaggatgatgctggcctcataaaatgagttagggaggattccctctttttcttttgattggaatagtttcagaaggaatggtaccagctcctccttgtacctctggtagaattcggctgtgaatccgtctggtcctggactttttttggttggtaggctattaatgattgcctcaatttcagaccctgttatgggtctattcagggattcaacttcttcctggtttagtcttgggagggtgtatgtgtccaggaatttatccatttcttctagattttctagtttatttgcgtagaggtgtttatagtattctctgatggtaatttgtatttctgtgggattggtggtgatatcccctttatcattattgcgtctatttgattcttctttcttttcttcttttttagtcttgctgtgtggtctatcaattttgttaatcttttcaaaaaaccagctcctggattcattgattttttgaagggtcttttgtgtctctatctccttcagttctgctctgattttagttatttcttgccttctgctagcttttgaatgtgtttgctcttgcttctctagttcttttcattgtgatgtagggtgtcaattttagatctttcctgctttctcttgtgggcatttagtgctataaatttccctccacatactgctttgaatgtgtcccagagatgctggtttgttgtgtctttgttctcactggtttcaaagaacatctttatttttgccttcatttcattatgtacccagtagtcattcaggagcaggttgttcagtttccatgtagttgagtggttttgagtgagtttcttaatcctgagttctagtttgattacactgtggtctgagagacagtttgttataatttctgttgaggagtgctttacttccaactatgtggttagttttggaataactgcgatgtggtgctgagaagaatgtatattttgttgatttggggtgtagagttctgtagatgtctattaggtccacttggtgcagagttgagttcaattcctggatatcctttttaactttctgtctcgttgatctgtctaatgttgatcagagcgcctctccccctccaaaggaacgcagctcctctccagcaaggaacaaagctggacagagaatgactttgatgagttgagagaagaaggcttcagacgatcaaacttctccgagctaaaggaggaagttcgaacacatcgcaaagaagttaaaaccttgaaaaaagattagacgaatggctaactagaataaccattgtagagaagtccttaaatgacccgatggagcagaaaaccatggcacgagaactatgtgatgaacacataagcttcagtagccaatttgatcaactggaagaaagggtatcagtgattgaagatcaaatgaatgaaatgaagcgagaagagaagtttagagaaaaaagagtaaaaagaaatgaacaaagcctccaagaaatatgggactatgtgaaaagaccaaatctacgtctgattggtgtgcctgaaagtgacaggaagaatggaaccacgttggaaaagactctgcaggttattatccaggagaacttccccaacctagcaaggcaggccaacattcaaattcaggaaatacagagagcaccacaaagatactccttgagaagagcaactccaaaacacataattgtcagattcaccaaagttgaaatgaaggaaaaaatgttaagggcagccagagataaaggtcgggttacccacaaagggaagcccatcagactaacagctgatctctcagcagaaactctataagccagaagagagtgggggccgatattcaacattcttaaagaaaagaattttcaacccagaatttcatatccagccaaactaagcttcataactgaaggagaaataaaatcctttacagacaagcaaatgctgagacatcctgaaggaagcactaaacatggaaaggaacagctgttaccagccactgcaaaaacatgccaaattgtaaagaccatcgatgctaggaagaaactgcagcaactaacgagcaaaataaccagctaaattcataatgacaggatcaaattcacacataacaatattaaccttaaatgtaaatgggctaaatgctccaataaaagacacagactggcaaattggataaagagtcaagacccatcagtgtgctgtattcaggagacccatctcatgtgcagagacacacataggctcaaaataaagggatggaggaagagctaccaagcaaatggaaaacaaaaaaggcaggagttgcaatcctagtctctgataaaacagactttaaaccaacaaagatcaaaagagacaaagaaggccattacgtaatggtaaagggatcaattcaacaagaagagctaactatcctaaatatatatgcacccaatacaggagcacccagattcataaagcaagtccttacagacctacaaagagacttagactcccacacaataatagtgggagattttaacaccccactgtcaacattagattctatgagattctaatattctaaattcttagtgttggagctatatgtagtttgctaggaaaatgttttcaaactgcaaatcaatgctgctgcctccctattaataagttttaaatgatttgtgtttatttttgcaaacatcttttaaagtggaaagatgagaatttaactctgtcatcttaaatttgggttaaaatggatataaataagttttgatgcatttttcaagctttgaaatgggtaacatgactttcaagttggaaaaagataaatcagttgaaacaaaatcgctgtgagactgctgatttagctgtgagtatgtgttgggatggagggcatgcacatgcataggtgcacatgtgttggagtctatgaaagctgtctattaagataatgctgttcttaagattgtccaaagcatttttaatgttatattttcctgtgatagtcagagtttaatattggatagctttttatgctgtcatcaaagggcaacttcgtgcttctctctttttcccttaccaaattccataattagtgtcatcgcctcatatccagtcgggcatatttcagccctctgcttaatataaggtcctttgacgatcagagagagcccagatgaggactgttgtagttgcctatgacagtgcaatggtagctaaatgtaggggaaagggtattgaagataaagtctgaaaacctgattttaattatatctttgtcacataactgagtaagtcacgtaacttatctgtgttcagcttctgcatctataaaatgggagcagtattataggtctcacatatttgttgcagttgacacaaaaaacttgttcagcaaatgattgtttggaatttgtctattcataattcaaaataacgatatatatgtggaaaattgttgtaaattaatcaacagtatcagcaattgactccatctggagttattcatatgaaagaagaccaagatcagagagaatgtctttaggaatttgctatgaaagaagggacagggactgatattagttgaatgcctaatatgtgctaggtaccatgctaaattttttatatgtttattcattactttcattttcaataaataattatcagtcacatactgtgtttaagtgctaatctaggcattgggtaataacactattgagatatttattttattagatttggattttatttattggattttatgtgtttatccagcttttttgggttatattaataattaaataaaaatagtataaatttaaggttgacaatgtgacaatttgatatatgcatagattgtataatgattattacaatcaaattaatacatagttgatctattatcagacataattacctttgtgtttctgtgtgtgtgtgtgtgtgtgtagtgaggacatttaatatctactctcagcagatttcaagtataaaatacagtattagttactatggtcagcatgctatatggtagatccccagaatgtagtctttataactgaaaatttctgccatttgactaacatcttcccatttcttccaccctcaccccttggcaaacaccattctactctctgttcatatgagaaactcagagagttatttggattccacataagtgagatcatatagtatttatctttctgtgtctggcttatttcacttagcttaatgtcctccagattcatccacaaatggcaggattttgttctttattatggctgaatatttctttacatacatctgtgtgtgtgtgtatcacattttcttcatttatctgttgatagacacaggttgatgttacatcttggctattttgaataatgctgcaatgaacatggaagtgcagatatctcttcaaaatcctgatttcatttcctttggatatgtatccagaagtggagttgctgaaaattataattttacttttaattttttaggaacctccattgtgttttccataatagctgacccaatttacatcctcaaaaactgtgtacaaatgttcccttttctccatacactaactggcatttgttatctcagacttttgataatcatcattctaacaggtgtgaggtgatatctcgttgtggctttaatttgtacttcccttatgattactaattttgagctgtttcatatacctcttggccatttttaggtattctcttgaaaactgtttattcaggtcctttgttcatttttaaattgggctgtttgttgtttttgctattgagttgtatgagttctttgaatattttggatattagcccctcatcagacctgtgatttgcaaatattttctccccttctgtaggttgcctttttcattatgttgattgctttttttttgctatgcagaatatttttagtctgatgtaatcccacttgctaatttttgcttttgttgactgtgttgttgttgtatccaaaaaactcattgctaaggccagtgtcacagagctttgtccttatgtttttagctaaaagttttacagttttgggactcacatttgtgtctttattccattttgagttgatttttctgtatgtcataagagaaggatctaatttcatttccccaaccctatctagctgcccaaccaatttattgaagagaagattcttcctccattgtgttttcttggtgcccttgtaaaagattgtgtagatttagttctgggatctcattctgtcccattggtgtatgtgtctgtttatatgcaatcaccatactattttcattacgattctgtagtgattagtttgaaatcaggaaatctgacggctccagctttgttcttcattctcaagattattttggatattgtagttatatatgaattttaggattttttttctatttctgtgaattttgatagggattgcattggaatattgatagagattgcattgaatctgtaatcacttcgggttttatggacatttttacaatattaatttttccattccatgaacagatatttttccactgatgtgtcttcaatttctttaatcaatatattatagttttcaatgtacacatcattcacatccttgatgaaattaattttaagtagtttattctttttgttgctactttaagtgggatcattttcttaatttctttttcaatactgtgttgaataggataggcaagagaaggcatccttgtcttctgctgcttttcaaggagaatgcttccagcttttgcccattcagtatgatattggctttgggcttgtcatttgtgatgcttattattttgaggtatgttccttcaatacctattttattgggagtttttaacatgaatggatgttgaattttattgaaagcctttttctgcatctcttgagataatcatgtggtttttgtctttagttctgtttttgtgatgaatcacatttattgatttgtgtatgttgaactaaccttgcaacccagggataatgcctacttgatgatagtgggtaagctttttttttttttttttttgagatggagtctcactctgttgcccaggctggagtgcaatggtgtgatctcagctcactccaacctctgcctcctggattcaagtgattgtcctgcctcagcctccccagtagctgggattacaggcacccaccactgagcctggctaatttttgtatttttagtagagatggggtttcactatgttggccaagctggtctcgaactcctgacctcgtgatctgcctgccttagcctctcaaagtgctgggattacagacgtgagccaccacgcccggctgttagtgggtaagctttttgatttgttgctggattcagtttgccagtattttgttgaagaattttgcatcagtgttcatcaaggatgctggccctaagttttttttctttttttattgtatctctgccaggttttggtatcaggatgatgctgcccttacagaatgagttagggaggagtccctcctcaattttttggaatagttttagtaggaatggtaccagctcttctggtatgaaacgtaaatgagtttagtataagatatataaaaaccaaattttattggtgttctaaaggaatcaaatgtattattctgctgaggactggggatactttcagaaaagatgtggcatgagaggtggacttggaagcatgtgacaaatttgacttctggaagagggactaggggaggccttttttaaatctatatttattctgaaaataaaagatagtaattccgtagatatataaaaattgtaggatttatgggttaagatggtctcctttaaaaaatgaattattgaggggtggatcaagatggaagaacagaagtttccactgactgtctccttcacagggacaccaaattcaacaagcacgtgtgcacatgcacacacacacacacacaaatacctccataagaaccagaatcaggtgaatactcacagtatctgatttaaacttcatatcgctgaaagaggcactgaagactgtgggaaagacagtcctcaattgttgacactataccttcccaattccccctgtagtagctgcaaagcatggagaaatttgtacactggagagaaggagactgcagtgattgtgagactttgtattgaactcagtgctgtcctgtcatagcagaaagcaaaaccaggctgaattcagctgacactcacacagagggagcatttagaccagccctaggcagaggggaatcacccatgccagtgttcagaacttgagttctgccaaaccttgccaccatggactaaagtgctctggagtcttaaataaacttgaaagtcagtccaggccacaagtactgcaagttttagtgctgagctgggcctggagccagtggacttgtgggagacacaacttactgagataccaacttgggcagctaagggaatgcttgcagcacccctccctcaaccccaggcagtgcaacttacatctccaaaagagacttcttcctttcgcttaaggagaagagagggaaaagtaaagaggactttgtcttgcatcttggataccagctcagccacagtaggatagggcaccagtcagagtcatgaggcccccatttcaggcactagttcccagacatttctagacacaccatgggccacaaggggaacctactgtattgaagggaaggatccagtcctagctggacccatcacctaaagagcccttgggccctgaataaccaccagcgatacccagctactattctgtgggccttaagcaagactctaagatgcactggcttcaagtgagactcagcaatctcagttgtggaggctacagtgagcgacttcatctggttgagaaaagcagaggggaaagtaaaagggcctttgtcttacaccttaggtaccagctcagccccagtaaggtagagcaataagtaggccattgaggttcctgattctaggccttgctcttgtgtagcatttctggacctgccctgggccagagggcagcccattgccccaaaggataagccccaggcctggcagcattcacgcaagtggactgaagagcccttgggccttaagtgaacatcagcggtagcctgtttgatgtccctgtgggcctatggtggtggtggccacagggtgagcctcctctgcctgtggaaaggggagggaagagtaggaaggtgtatcatggtttcagggccagctcaaccacactagaatagaaaaccacgtagacttccaagtttttttattccagtccttagctatcagatggcatctctgggccttggggtaactcactgcagtgaagcaaaggatacaagcctggctaactttgccacctgctgcttttagagcccaagggccttaagaaaacaaaggcagtagctaggcagtggttacagcaggtcttgagcaagacccagtgttgtactggctttaggtctgacccagcactgtcctagtgttggtggccacagggttgtttgtgtccctctatcccaagccccaggtggctcagcacagagagagagactcccattgtttgggagaaagtaagggaagagaaaaagtctctgcctggtaatccagataattcttctgggtcttatccaagaccaccaaggtggtacctctatgggtgtgtaaaaaccacagcattactgggcttgggtgcccccagtgcagagctaatgcaggtggcattagatctagggcttagatcacaacaccgaggccctttcaaatacctggaaagccttcccaagaaggacaagtacaaacaagcccaaactatgaagactgcaataaattctgaactcttcatgcacagacacaagtgaacatcaactagcatcaagatcatccaggaaaatgtgacttcaccaaatgaacgaaataaagcaccagcgactaatcctggagaaacagagatatgtgacctttcagacagagaactgaaaattgctgttttgaggaaattaagaaatctgagataacacagaaaaggaattcagaattctgtcaggtacatttaacaaagaaattgaaataattaaaaacctcaagcagaaattctaaaattgaaaaatgtaattgacatactgaagaatgcatcagtctctttaatagcagaattgatcaagccgaagaaagaattagtgagcttgaagacaagctacttgaaaatacacagtcagaggaataaaattaaatacctagcaatgaacttgaccaaataagtgaaagatctctacaatgaaaggtatataacattgattcaagaaattgaagaagacacaaaaaatggaaatatatttcatgttttgaagaagacaccaaaaatggaaatatatttcatgttgatggattggaagaatcaatattgttaaaacatccatactacccaaagcaaactacagattcaatgcaattcctatcaaaataccaatgacattcttcacagaaatataaaacataaccttaaaatgtatacagaatcacaaaagacccagaatagctaaaactatagagcaaaaagaacaaaactcaaggaattacaatacctgacttcaaattatactacagagctatagtaaccaaaataacgtggtactggcataaagaccaacacattgaccagtggaacagaacagagaacccagaatatagccatacatctatagttaactcaattttgacaaaggtgccaagaacatacatttgggaaaggacagtctcttcaataaatgatgctgggaaaactggatatgcatatgctgggaaaactggatatgcagaagaaagaaactagaccactatgtcatcatatagaaaaatcaaattaaaatgggttaaagacttaaatctaagacctcaaactatgaaaccactaaaagaaaacattagagaaactcttcaggacattggagtgggcagatttcttgagtaacatcccacaagcacaggcaatgaaagtgaaaatggacaaatgggatcacatcaagttaaaaatcttctgcacagcaaaggaaacaattagcaaagtgaagagacaacccacagaatgggagaaaatatttgcaaactacccatctaacaagagattaataaccagaatatgtaaggagctcaaacaactcaataggaaaaaaaaaaatctaataatctgattttaaaatggacaaaaggtctgagtagatatttctcacaagaagagaaatggcaaacaggtatatgaaaaaatgcttaatatctttgatcatcagagaaatgcaaatcaaaagtacaatacaatagcatctcacctcagttaaaatggcttttatcccaagagacaggtaataataaatactggagaaaatctggagcaaagggaacccttgtacattgttggtgggaatgtaaattagtacaaccaatatggggaatagtttgtaggttcctcagaaaactaaaaatagagctaccatacaacccagcaatcctactcttaagtatatgtccaaaagaagggaagtaagtatatggaagagatacctgcactcccatgtttattgtagtacccttcacaatagccaagatttggaagaaacctaagtgtccatcaacagacaaatgaataaagaaaatgtggtacatatacacaatggggtactattcagccataaaaagaatgagatcctgtcatttgcgataagatggatggacctggaaatcattaggttaactgaaacaagccaggcacagaaagacaaacttccttctttttctcttgttctctctttctctttttcccttcccttcctttttctttccttctgtctctgtctctctctctttctctatctttctctctttctctctccctttctctctttcctttttcttgctgcttttatgctaagggctggcattctgattgctcttttttcaggtttaatccttattttaataaagttttcaagcaaaaaaaaaaacaaagtaaggcaaatttcccacgttctcacttgtggaaactaaaatgtaaaaaattgaattcatggagatagacagcagaagggtggttactagacactgggaatggtagtagggtggtcatggcgaagtggggatggttaatgggtacaaaaaagagaaagaatgaataagacctagtatttgctggcacaacaggatgactatagtaaaaaataatttaattgtacatttaaaaataactaagagtataattatatataatatatactgtgtacccacaattaaaaataaaaaattaataaaaaagaaaccaccacacaaaaaatactaaaaaaatgaattcttaatattttcacttgatatgctaaattgggtcacaggatttacttttgtgacatcaattaacattacttagcactccttatgtgtttattcaaaatatagcagacatttgccattctctggggatatatttaaagttctggtaaatcagaaatccttgaaaaataatagactcaatattattttctaaagagtgagtggatgaactctaggtagaataataacattgagtattaatatggtggtgggaggtacagaaagtttgcaaaaaacattgagttacccattttgattggaacatggagtcaattacagtggtagaggtggatgaacctgggaaactggagccctagtgttgaagatcttacaggactgtcagaaagaaattttgaattgcccacatctaacaatgatttagaatgaaattttgacttgatattttaatgtatttctcttccctaacatgcttcagtattcaatatcctttatgataaacaacctgggaggtagaaacagtattttccacacgatggacattcctgtgcaggaattggaatgcacattgaaagacctactgagagttttatcaggaggagagctttctgtgatagacagtcatttggaatccattttccttcatttgggagtagttcccaggccaaatcactgttctatttatatccatgacctccttttcaacactgtaccagctgagcactgtgtagagtcatccttaaaagcagccgtatttgggtcaaaaatgtcaaccaaaatgagtgtaattagacaaaaatttttttttaaagaaagaatgaagaggctgttttgtttttgttttgtttttgtttttgtttgtagccttgtcagtaaatccttaaacctgtttccatttgaattgctaaatcattatgtacaatgagcttgggtgtgtttaattgagctcaacaaactttctttggatcattgaatgcctactgtgccagattctcagcatgtgtggtgtgtacgtgtgtgcatgtgcacatttggactggttgttgtagtctgcactttcaacaaacaaggaaatatctggaaaagtttattaccctatggatggagtggagaacagagaaggagtacatgggaatagctggggtcaggttagaagtgcttttctcctttctgaaagccactgctctttaaaaaaaaaaaaaggtggatatcggggtgaatattgtactatttttaactcacttcatatacagaagtcttcagactttgggaatcatttaaaacaactgaagcttgtgaatgcagatagctggcccttatatccatattttgattcagtaaatccaagtggagcctgggaatctaatttttaacaaataccttctgggtgattcttatgcaggttgtcctgaattttgcaattgaaaacttgcttaagggccacttctgacccctaagtgtagaaattgaatgcaatttaaagcatttaatagaactcttatgggcatcctgatactgtactcaggtccagggatataaagttaagtaaatatctagtaggcggagaggagtataaacatacacacacacattaacatgatacatactgtgagagtgatagaaatttgtccatcaggtatggttgtaagaaagttacagatacccccttgccaaacaaaaagaaagaaaattacagatccagaaatcaggaaagaaaagttgaaaatcctgagggctgagtgctgagatagactttgcctagtttgcagctttgtttgggatgtgccctgaaaaagtcgtatactcagtgaagtggaaacggtttttctctttgcatcttctcctttaaaagtaatatgtgcatccatgaggctttcaggggcctttagaaagagtaaataagcctagtttcaatccatcgtctccgttagggtctctgagaatcagactgtgaatttaaagctgtactggagaaaaaagctacccacatctaaaaatgatggtgggcattaagagatgagatgaccttttattttcctgagcctatgcaaggagtgggtacctatgtacacagattcttctctctgaagtgcctgtgtaggttaatgacaatgccagctgaggactttcagttcttcatatgacagattaatgcccatagaaagttagaggtattatgaggttactttaatgactctttatcacaccttagttctgtagatattacccatgacttcacatggaggacaagtacggagctccagcctctgcaacattaatctcattaatatacaaaaattattgctagaatattaatctttcgcatcataaaataagatcctataatgcagatcttcatattgaatgactacaaggttacttacagaaactaaaaaaaatcttaataactttcctttttggtaatcacatttatggggaaggataaaattaaaatgtggaggtagaatcacaatataatgtctgattaaaatgcttatgcttatgcccagatgccaaagaggtagaggctgcttctttgttccctatgggaggtggagcccctttttcctcagttttgtttatctcttgttctggtcccagcaactgggaccaggggcactccctcctctagagctagggagaccgaggtatggcaattttcaggctaccccaccctgccagtcatcacctgtgatgacttagttttctactggcaccactagtcttggtgagcatcctgctttcaggaaggagtgccctcttaacccccataaatactgggagaataacctacagggttgtggctggcaccgggactcaggcaatagctggtatgttgagttggctaaaaaagtgacaactgaggagtgtgccattttctcaataacagcaggaaaggggaggaaagcagcggaggtggtgggtgaaaagaaggtggagagatgctggtggaggaagaaatgtaggttgaagaagagttgatgaagtgatatccatgtagagaagagaggaaatgatgaaggaaaataaagtgacagagatgaaggaggaggcaaagccctggcctctgaatgccacggactttctgaaggctggagctggagacagtacctgcacaggctaacaggggcttcctccagctggagcccaagtttgggtggatatggtgacactgagatgagaccacagattcatcaaacaaaaaatatcccttctgggatgccaccttttgaaaccacccccacccaaggtcatgcgtaggggccaaggtgcagatttgctgagggccatctcaattaagaggtaaagagttcagacatctaacgacatgctacatgttcaaaatctttttttgaacaaacctctacttcagaaacaaggtaatcattaaacaatatggggttagatcctctggacaagtgggatttcctttcattccagtcacatggcaaggatcccatgccccagtcctgtaggagcaggatatcacctataggttcttcatctggtcctcagactgtagccttccagaacctgataagattgctgttatttttaaagggatctctagcccaactcctgaaataccaactgtcatgtggagggaaagccaggttaccttcagcagggcagcccatggagatactcaggctgttctggtatcagtgtagccaactcctacttttggaagttgcccctgctccagatcatctgccatctattgttggacctgtgcttggccaacagtgatgtctatgtgctgacctccttgcatcttggcttctccggacttttagtgctcccagcttcaagaatgtggcttttatgaacatgcccatcactttgtctaagccaggaaaatggtgaaaactgcattctttcatctacatggcttgaacccttgtctgtgtcagggccttcctgtctctctttgatgtaggtctttatgagttatcttcaaagagggtcagtgtatctttaagaaccgcaacctcaggaacaacgaaaggctgggttcaaggctggtggcaagctggttatcttcgagtatgtcccatgggcgttccatggacctaatacctttgcttgaccacaatcacgtagattttcatctttggttaagagttcacttcagccaccctactgagtatctggcaacacagggacataaacagtggcaagttgctgtgtatgtctgaagtgaaggataaaaagtagagggcctcttaatgtacccaagaccatagtttttcctgctcttctgttactagtaagtatccatgaaagtctgggctatggttttgtgtgtgtgtgtttgtgtttcctggccaaccttttggatattcttgtgcagaccgccattgacctcattgttcagtttctagtcaccaaagacttccacaactgcttatggactcagactcttggccaaccattggagaagccctctactatgccccatcctccctgtcacccaggaaccacaacaaatgtcagctgattgggctggcaggtgtggcccagttctctcagcaagggaaatatggcatcctttctaagaaccaagcattcttggtgacagccaataagcccatgaagaatatgggacatttaccagtcccctttcacccacctgagcatgatgaggtgtccaggtgctctgtgagatactaagagagaaaagaaagcatttctcatctttaaagtttatctatatctgtctgcctacatcttattccaatatctcttctctctctgtctctttttaaggcaccagagcaccctagaacacaaaacggctggaaagcagactttctaatttgctgcttctcttgattgtgtcctgggaagattgttcagtaatgtagactctgaacctctgctcttatgccccatagaaaattcaaagaggcacagacctaggactgtcagattgaaggactgaggtggtcaccagtcccatggaacagggatggttaattgcctaattgtgtacattgttctttttggctaatcttatcctcaatactgaccccctcaccccgacttctttcttccatctgtgcccaaatatccaagaagttcccagatatttcttaagtattagcctagagggcaaggagaaaaatgttatgggaatgaaatttaattaggagctaaaagaaattcttttaaatgatctaaaactaaaataaacaaacaaggtaaatgggatgggcgtggtggcttatgcctgtaatcccagcactttgggaggctgaggtgcacaaatctcttgagcccaggagttcgagactagcctgggcaacatggtgaaaccctgtctctacaaaaattaaaaaaaaaaaaaaggcaggcatggtgacatgcgcctgtagtcccagctacaagggaggctgaggtgggaggattgcttgaacccgggatggaggggttgcagagagcccacatcatgccaccgtactccagtctaagtaggcagagtgagaccctgtcttaaaaaaacaaaaaaacaaggtgaatgcatagctctaatatatttatttacaccacctttatttctggaataatgtaaagattttgattctgaagttttgagaaaagataaactgagataggcaaattcttcaaagttttataaaagcagctatagtaatatgtaagggagcagttgtatgtatttttagtacttaagcctcctcttctatgttcagaaaataatgtaagttttttcagacatttgcataagcattatcttttccccatctccatgcttagtttagccatctttattcttacccagtgccattcacgaacaggtgggagatggtgaaaataaatgaaatgcactattttaaactgtgtctgttgtatttaaactatataaaaacactgaggcaattataaaggaattcagaacaaagtcaacttttagacagtttttctttttttttttttttttttttgtagtctgtttaccatgtccacttgtttcattttggtttagctcaaggaaataaactcaggagcaatggaattgatacatgacactttcacttttcctgctcctcatgaagcaaaacccactaattactttgaaggaatccactaacacttccacatatatttaattttgctaaacttgtatagagctgccttagaggaagagagaagagagaaaaatggagcattcctggaaagctgcattaagactgttgtgtttctgccaatattcttaaggtgccgaatatatctggaaagaaaaaaaatcacaaagatatattacatacactttacttaatgtatatgccaattacttaaactttccagacattttgatattagagaatgtgtgattatttattcattcatgcagtacacaaggtagtttggcatttcccattctctatacattaagcatagccatgtaacttgctctggtcaatgaatcatgaaaagaagatatatatgtcacatctgggaggaagctttaagagctcctgtacaattgggtcagaacctcttttcctttgctgtggcgactagttcccgacgtggaggttctgttagcattgttcctggagtgaagagatgtggcacagtttctcccctccaccccaatcccttaatccaaatggatatgtagaatgaatgagaaatacactgttgctaatttagtgcattaagatttggaggttaaattgttactgtatcataatctaacccagcctatgaaaacattttttaggtttctgtatgttggatatttatgaataattgtgagaatttcatttcctaatatgtgtcactgtttttttgatgtctgtgtcttccctacctctttggtcctattgtttctaatatttggaaactaaatatatatatttagtttacacacctatggagagaaagagagaaaggtctcgttctcgctttgtcacccagtctggagtgcagtggtgaaatcatagcccactgcagccttgatctcctgggctctagcaattccaagtagctgggactataggtaaggtccaccttacctggataatttttatttttgtaaagattgaggtctcactgttgcccaggctggtcttgaactcctggactcaagcagtcctcctgccttggtctcccaaaatgttgggattccaggtgtcagccaccacgcctagtcttaaagttttatacaatcatgtacggattgtaatatgaatttgtcatatttacattgtgcccacatttattttctacttcattcatttatgtatcagttggtaacatattggtctaacttttctatgcaattagagtacatactcctaaggagaaaatgcaacatataactaactaatctccatgtattcttgtgcaaattctagtcatacatatttaatggaattcaatgcatttttttttctgaaaagataattgagatgctgatgaggatgatgatggtgatagacatttcaggaagtgattgtgctctaggaacttggatgttcagagctactgcaaagcattttgatttgtgcaggcaatttactgactatatgttctgatatctgactaccagaaataagttttgaagtacacagctaatagcatcatagatagattttcaaagtgtatacaaatatgaacgggtgggataatgtgaagattagcaaagaacattgtcttattaggggtaaaatggtaaataggcacattttagatgtttattctttgatgggtgtcttcctcagtgagaattatttccaggaagtatattttagtctttggaataaaacttttgccaactcatattgcattgtctttctattcttatagtataattttattttcatttttctggcatcagaaaacaggtcttaaagtgaaatttttgaatataatgatagatctgggggtatttgaatcagttttaatgcatatttcctgatgatcaagtgataagttttgcactgttggtctcatgagcttcttaagtgttctcataatattccctaaattagtgctcatataatttcatgcagtatatctttttaatattgtagtgttggaatgcttttacatggaaatttaatttttgatattaaaaataacagaatattttataataattcttggtatatttatgctggaagcatctccatcactgacgcatatttttcctatacagatctacatagcacacagatctagatggcgctcataaaatgaatggtgaaaataagcaaacagtgaaaattacttattgtgattatggttagcatggttgattgacttattcatttagcaaatattcaataaatatgagatatttaataaatagctatattatagacattatgctaagctctgtgaatacagagatgaaaaaaacatagtcccatttcttttttttttgagatgatggagtctcgctgtgttgcccaggctggagtgcagtggcgtgatctccgctcactgcaagctccgcctcccaggttcacaccattctcctacctcagtctcccgagtagctgggactacaggtgcccgccatcatgcccggctaattctttttgtacttttagtagagatggggtttcaccgtgttagccaggatggtcttgatctcctgaacatagtcccatttcttaaaagctcacatcgtagccagggatatgtattgactttatatagatacatattgattatagcttgtgctgaacgttaaagcagaaagatgtggaagtgctgtggaaacagaataaagaaaggattagttctttgagaaattatttgataaaaactaaaggaaggaacatggagcacatcacagaaaaagtgacactggaattgtgcatttagtacaatttttcatcacttcagcctaattaataatattaaaactattgaggattttattaggttggtgcaaaagtaattgcagtttttgccattaataccaccatctctattgtggataattagagagcttttctctaaagtaatagaacttttattccatgttctatgctttggaaatttgggagttttaacctggggtaaatatttaaaatatttattaacagcaatggacattcagaatggatgtgacaatagaattagaagagggtctggaaagacccctacggtagctgttaactctcaattatatggttatggatgggcctctgcacctcaatttttcatctttcaaatgtcactaatacttgtttcttcctttttttaaaaattatactttaggttctggggtacatgtgcagaacatgcaggttttgttacataggtatacacgtaccatggtggtttgctgcacccatcaacctgtcatctacattagatattctcctaatgctatcccacccctagccccccaccccccgacaggccccagcatgtgatgtccctgtccctgtgtccacatgttctcattgttcaactcctacttatgagtgagaacatgcagtgtttggttttccgttcctgtgttagtttgctgagaacaatggcttccagcttcaaccatgtccctgcaaaagacatgaactcatcctttttcatggctgcatagtattccatggtgtatatgtgccacttttttttttttttttttttgagaccaagtctcactctgtcaccaggctggagcgcagtggtgcaatctcggctcactgcaacctccgcctactgggttcaagcgattctcctgcctcagcctccctactagctgggaccacaggcacgcaccaccgtgcccagttaatttttgtattttcagtagagatggggttttaccatgttggaggatggtctcgatatgctgacctcgtgatccgctgcctcaacctcccaaagtgctggggctacaggagtgagccactgcacctggcccaatacttgtttctttcatgtaggatatttgtgaagataaaatgagacaatgtacataaagtggttgacgcaatggtatggggtatgaatatttaagaaacattaggcgttacaatttttaagagtaagaaagaacagacctgacgaaaaattacagatatatctaaaagtgtggaacaattttcttcaggtggaaaaactgggaaaaaaatgctttccaaaggaatacttgaaagttggaaggagatgaagggatggctctggaaaaggcgattatttggaaattatctaggcaaaatactgacagtcctgttttcgtgggggataattattttatattatagttgttcctaatttcaatgatcatctctagtgataatgttaatgaacaaccctggagtgagatgtcagtatttgactgtggctgtttgcaaactctgctgtgattataaacagtagtctaattgcttaatttattgatgttttgccgacatgtttttcagcaacatttgtgattgcagataactaatcatttctctttgggctcattatcatacgtttgcatttgatttgtctgattgctgcaggtggaaacaataggtgatgcctactgtgttgcagcagggctccacagaaaaagcctctgccatgctaaacccattgctctgatggccttgaagatgatggaactttcagaagaggtgctgacacctgatggaagaccgattcaggtaaccctcccaacaatctagtttgagtagtaagtgcaccattaactggaggaggcaaataattcccttccaagttctactttttgtaatttatagatctagacaagttgggtgcttaaggaggacaaggagtgactagagataactcataaatccaggaaaagaacaaatggaataggtccaagataggaaatggtttgtggaaggcaaattactgtggaggaaagaaagagctaaaagattagacccaagggaagaacttactgtcagtgaccaggtcacgaaatccaagcaagaatgatgatgatgagattcggagttttagaggtaatccaagaagtaaaacacaaaaaaagcaagaaaatggaggacctgcgcaacttcctgtagatagtatacaggtattccttgtgaaacatcagacctcagagttacttctggagtttttcttgtggcagagtttgaagattgcagcctgtgaaaactttaaaaacagtggaaagtccagatcctggtgtgttgtactcttgggtctgatggtcttctgcaatctgaggtctacctctgggaatgaagaatgaatgaggtcatctaccatatttctgcttgagcccagtgatggatcccagaagtgtcattactttgaaatcagaaatcttatatttggggaagtaaacttgtattcaagtccacccttttataacagcttaccagctaagagttaagaaaacacgggggcgggggggcgggcacaggaaatggctaaaaatatgagtaccgttctagttctggcattatagcagattggggacactgaacaatccatctgattaaaattatgaaaatattgggttaaatatattaaaaaatatttttaaaaaactattaggcacttctctgagctcacaggaacaggaaaaacatgacaattacactacgtgtgtagattgaaaaaaaaaaacgtaattggtgaatttaacttaagagccctgttattagcaatgatagaaggaaactgggaaatactattcccccctggaggatgccaacttcaatcctatcctcaaattatttccacagattccatgtgttgtaaaaataaggtcctagtttgtggttgtatttttatcttttagttgttcttgataaaccagaaggtttaattttaatgttttaaatgatacatattttcttttataatttgtaaatttttgacctgaccagttcacaaaaaattcttcctgacttaagtcagaatttcctaatgataaatttgcagtttcatagtatgggtttttacatttaacccacctggaagataaaggttattaaaacgagtaataaaaaagaaaaaagccacacacacatgaaaacaaagtactatggggaagaaccgggggaaattatagatgtgaaaaaacatacctgggatgttttcagatatcaaacttatcagacacagaattaaaatgacaatttttaacgtaactataagaaataaaaagagctgaaaactgtgagaaagggacaagacttgggaaagaatcagagaacttctaagcaatcaacacgatgcttaagaaaagaagagagaacaaagtggacaagtttaaaagcagattagacatagatgaagcaagagcttgttcactaaaagaactgaagaaattatcaataactaagttcagatatttaaaaatggggaatatgaataagagaatgtaaaatataaaatatgtgggagacagggcggagagagtggaaagatgtaatatatattcaattgaggttccaaatgaaggtaacagagtgaatacaaaaaagagaattattttcaggaactattaaaagatgtcaatcagtacccagacacagtaatcagcacccagacacagtaattccaaagaattctgcaaaagttaaaccataggaatccaaaactaaacccatcttaacgagactgcagggcatcagagaaaaagagcaattgataaattataaaagtgacagcctgggcacggtggcttacgtctgtaatcccagcacttagggaggctgagagggtggatcacaaggtcaggagttcaagaccagtttggccaagatggtgaaaccctgtctgtactaaaaatacaaaaaattagccaggtgtggtggcgggcgtctgtaatcccagctactcaggaggctgaggcagagaatggcgtgaacccgggaggcagaggttgccgtgaaccgagatgcgccactgcactccagcctgggtgacagagcgagactccatctcaaaaaaaaaaaattataaaagtgacattgattggtgtgaaaaggacaaggcattcaataaatgcttgggggactcttggctattcatgaagaaaactaattgaaattggtattgtactttatgaatctttatataaatcaatttttggtgtgggaggtaaatgtaaaaattcatattataaaactataaatttgtcattagaaaattttgacaagtagggaaggattttttgtgaacttatcaggtcaaaaatttgcaaatcataaaataaaagtttagaacattaaaattaaaaccttcctgttaagaagaactaaaaaattaaaatacaactacaaattaggagaatatttttgtgacacatgtaatcaataagtatctagttaaccttgtcagtaatcaaattaatagaaatttacaacactatcataagcatttctccctactagtttgacacaactttgaaagtctgacagtgccactgttggtgaggatctgtagcagcaggaaatctcacccatagctagtggaagtataaatggtacaatttacttggcatcacctggtaaagtttaacttttgcatgtcctacaacccagcatttcctctcctagacgtttacacatgtacaagggaagtacttgtgcacgtgtagcaaaagtcacacacaagaatagtttttgtaacagtctcaaactctagctaattcaaatatccatcaacagtaggatagataaactgtgttatatttataccttggtataccatatagttgggaatatgaaagacctcagctactgacatcaacatggatgaatgtcaaaaacataatcttgaacaaaagaatcaagtcattaaagaatgctgtagtattattccacttaactaaagtttaaaactggaaaaatggaaacaattctatttagaaatacttgcattgatggcaaaaagtgtaaaaaataaaaggaatgattaacacaaaattcaagctggtgcttatctctgagggaaagatatgggaagtaagaggatacaatagggaagataaacatagtataaaattttttattttattactcttctttaatatgcacatatatgtttatatttaaccatttataagtggaaagagagttttctaaccactcctaccagtgatgaaaatgggaaaatatggagcattaaaaataaaatctagtttaagttccctcagggaataattattgaatggtacttctaccatgccaggaaaacaaacaaaaggaatactgtctcacatttgctgcacactgcaaatatagacattccagattgaactaatcagttcttaaattttcaagcctaccagctgggcaggcttctcatttgggattgtttttgatgttggattttcttttatggagagtatgtttgtattgaatttagcattgtcatagcacagttaaattacccgagaacaaaaccagggaattgtgttttacagtgtgttcatcaatattttcatttgtgggatttaatattagctctttcttatgaatcagatagtcttattaaatcagaagaggaaatatccataaagatttaataagaatgcagaaagagaattcaaaataataaaccaccttagtaattttagcttccttactaatttatagtatttgcatgatttgggattatttttcatcatattaatttgattttaaattgccttctagcttggtgctgtgggaacatttccaaacttattgagagaatcttttattatgaaactgctggggtgttgtagtagagttgatatgtgatagcttactgtttacctcaaattatgtaagtttttaggtgatttaaattacaagttattataatagcaataattgactaaaactgaatccaaactttgaaaagtaaattgataatttgtatatggatttatgaacctttgaggcatcctgtaatgatgggaaataggagccaaaattgtcatatacaattgcttggaaatgattggtaatgcccttgactcactaattgtaaaactgcctgcatttatttttttttaattttgaaaataaccagagaatgtagcattttgttttttcagcctataaatactcaagtaaattattgttcaataagtactctaatgaaactcagaggctacttctggactatatctataaagcattcataaatatggtctatctatacaatacattctgaaaaatcagttcatgttgactttaattagaactgcttttataaaaagtgagtagaactttttcaccctggatcaatatgatatttcttctgctggctgaaaatatggaagaacagcattatgactgtttcctttttattcttcccaagggagaatctgattttcttgttttttttcctcaagacacagggtcttgctctgttgtccaggctggagtgcagtgtcaccatcacagcttactacagcctcaacctcctgtgctcaggggatcctcccaactcagtctctggagtagctgggaccacaaacatgtggaaccacacctgactatttaaaaaaaactttttagtagagatgggggtctctctatgttgcccaagctggtcgtgaactcctggcctcaagcaatcctcctgcctcagcctcccaaaatgttgggattacaggcatgagccaccatgccaggactgaatttttaaattttaaacagtagacaattgaaaagtaaaattatatttgtattctctcttccttgtttgcactagctatattgtgaattcaccagagaaatgtattactttagttctctaatcttgtgaacccaaaggtattttgaatagtttttagtgctgactggctaacttacactaatagtttaaccacactttgattaaaataaccaaatatttattactgcctatgacttattctttctttaaaaaacactgttgatagggaaagggaagttgggtcaaggattaactagagaatgtacctagggtatatgagaaagacaaatagcattttcacgatttaaggcttttgaagaatattgagtatgtccaaatgtcttttaattctgtacttagtttaaaaactattttcattaaattttatctcataggcatacaaattcaaattttcttcattagttcaaagacagtgcattttatataatgaggcaagtatgcaggaaacattgtgaactagagttaaacaatgtgtaatcatgttgtaatactaatgtgtttagcaatctcaattgcaaatcagggaaatgctatgagaaaaagactcacagcattccctgatttgcaattgagattgctaaacacattagtattactgcctggtgcaaaagcaggaatattaatgtgcaatttacatgtattgtaacacattaaattacagctccttaagcttcaacttttaatgagcttacaggattttttgagattatgcaataattgttctctaattaatttttaatttttagcttcaacttttaatgagcttacaggattttttgagattatgcaataattattctctaataatttttaatttttaaatagtttttgctatttccagaggaaacctgatgttgttattttaatatttggagggatttgggttttggaaatattgcaatatttaattaaccctatcagatttcagcctgagactgtatttagaaaaaagaaaaactaattacagttggcactccatatccatgagttctgcatcctccgattcagccaactgtgggtcaaaaatgtaggtaggccaatgatagttgcttcagtattgaacatgtatagacatttttttcttgtcattctctaaataatacagcctaacaactatttactcattatttacaacacgttacatattataagtaatctacaggggatttaaagatttaaagaatgtggtaggatgtccataggttgtatgcatgtacaacactacttaatataagggctgcaagtctcttatattacttataatacctaacaaaaagtaaatgctatataaatcattgtaatactatatcattttgtttgtagtttttaattgttgaattgttatttttgtttgttatattttttttattttttaatgccatattttcaatccacggttggttgaacatgcagatgtgaaacctgtggatacacagggtcgactgtatttggtaacctaattaattttctaagattctttgataattatttatttataaaactcaagttagtactttttaatcacattgagattaaaaacatataaggagaaaaacctaaggggtcagaaaaaactacataggcattatataaaattactgttaagatactgatcccagttatcctcatttctcacatttatcaattaggagtatttaaatttgcttttaatctcctagataatgcatatagtggcagttttcataagtcagtgttctattgtaacagtaatatggaaaaataccgtataatgttactggtgaaacttaggactagatagatatattttccgatagatttatcattttgaatagtaaatttatttgtaactataaatgtgtttgtttttaaaaagtatttatttaaagtattaatatttgtgagtgtaccagcaaagttatgagtctcttctgtagtttgcttccttttaataatcaatgcctcattctacatactctccttagatctattttccaacttgccaatacttccctcagttggttgtaaaaattattgattaaactcatccacttgatgcttaaatgctgattataccagtttatagtgttttgcagttccatttgtctgacaaaatttttcataccgtttttatttattttcttgaataaatcatctgtaatgattgtaaatgcttctcctggtaagtcagtctccagaactcctgcagtctattacatcatttgttctttcacttaattttcagtcatgttacttgtttcctgtgtgactaattacacttttttttgtttgaatgctggagattgtatataaaatattatagaaataatttaagacttaggatgattttgcagggaaattttagtgtgcttcttgaaagagactaggggctctagcagttagcgatcaggggatttaaagctgggttttggtctctgtgaggacctgtctacttctggttcacctctatgttttggtattacccttatacctgtggtcatgttcccatctcaaagtggggagggctttctaaggtctttgccctaggaattcttaggctccagtttatgttctcttggccctggctgtcaaaaatgctgctcagcttctcaacctttccattaccttttctggagccagaagatgcccacaggataaaagcaccaccaagtttacttttcacttctcaggtttatcttctgccatatcttggtacaataatttttcgttactttgttagctgaccagcatagggtaattcaaatgatataacctgctattttatatgtatatatgctaagtttcacaataattctgtgaaggaattattgctattatttccagtttgtaaatgaagaaaataagcataaaaaatagttaaccagagcttctaatatatatactgtgtatacattaaataaaagcatgttaaataacatttatattgtcaaatcttcctattgccttgaatattccattaaagttagacttttcatggctttagtcttcaataaatttaaatgtatgttagatgtcctctttgaaaaagtagaagtaagttctctattttaaaggtattccatccaaaaataaaataatttgtttttaaattagaaagtaagagacattctagctgcatgtggtggtaggggggcatacctgtagtcccagatactcgagaagctgaggagggaggatggctttaatccaggagttagacaccagcctgtgctggacagcataacaataccttatctagaaagagagagagagattgacattgattaaattcagttatgtgaaaaaaatgagtgttattctatcaatcattttgtaaactgcaatcactggccagattgggtgggggatgtattagtcatgatgctctgctttttttctatattttccccttgtttattgtttgttgtggattgtaatgcagaagctacatatttaaacgttttatatttacattatttcatagggtagtcattgaatttaaagattaggtcatattctatttaattatttttatttattgagcacatttgttttaagcatagaattactcttctggcatgatgctatagtgctgaactttaatacacaaatttatttatagacagatctacttactgagcacattatttgttttaattatagaattactcttctgacatgatgctatagtgctgaacttcaatagacagagcatccttaataccttacaattcctctgtaagatatcagcataatgatttaaaacacaatattgtgtctgtgatgtgtatgtcaatgagacagaattccactgctagtttattttagcttttatctgtaatcatgaaagattccaattttatataatcacagaattttaatcatattttcagactataaaatagtctatcaggcatacatttctaaaaatgctagtcttactgaaaagttttattatgatatttgtcaaacagatttcccaagcagtccttttgtgaagatatttgcatatttatgctacaagaaagaatagttaataagttagtgaaagaaaaaacaaaaccaagtgatgggaaaaaaagctaaactgattcacatgaaactgtgcatgcaaagcacaaaattgcttagtttgattttgtgcaacagtcttgactttcacatttttggaagaaaaatacattctttagtggagacatggtttgagtattttgttagttaaatattatcatcactatgaggataactacctttaaataagttataatctatttcatgtattttattcctgcctcttgtctccagtgtcccactaagactactgatacaatgtccatagaagaggctaaaagttatattagcaaagtcactcatttttatttgatttttgtgtggtgtgctttagaagtgtgagacttccaagcagttaggaagctcgtgtttttatttatctgacgtttatgtaaagaataggaatctccatctgccaatattttttccctggtagagacagtaaatgtgatttcatcaacccatttagtaggttagcccattatctttagcatatggtccctttcttaggtgtttttgaatgggtttttaatcttttactgacacttcagtctcttttaagcctatatgcatataggccaacatgagtagcctaactcttacaatatgaaaaatgatatgaaaatagcaagatacaacacataagacagtaatgtgctatctgcatgctaatcacactattgatttagttagttagttagcttttacgtttttgacctgttgttttgagatctcatatctcgtttcaaataaaagtttaaaaattatttaatctctttatttgttttctaaaattacaaaaaaaagatctctgaaaactagtattacagaagatagttaaaatcacctataatttaccaaccaattatagacatattttacatttttatgtatctttaaagtctttttatatgcaaacattcaatacaaacacatagaaatagaaggtatggacttaaaaagtagattattttaaaaactgaataagcttcattcaacttggtaatatcatgacacacagtgtaccaaagatgcagagaaatatgcagaaaaaacttggttagccctaggaagaatctttcattattattaactcactttggttttgtatttttctgttcctacaattgaatttttgagacactggaaggtaactctttaatcacctgagttgcaaatgtggtactaacaattcagtgtcacaagtgcttttcaaagtatgttaagctttttgttgatgtcatgtcaggcatatggtaattgtctgggtcaccactataatattccttatttggaatgtggtttcctagcaactcttgctttttcctaatggctgaattgatttctggacatttgtaatgcttcctactgcatcagaaattgtcaccttgtgtgtaaatgttacaagaccaaatttacatgtagattccattttaagaaattattttgctttatcacttgcctttaatgtgtttgttcagaggttaaaccaatcaatcataaaaaatgaatttagaaaacctcattaattcagactctttagggaaatatggtaattttgacaaattccaaaatatatgcaaatagttcttagtggggaacctcctgaagttgaagaaacagagtaattttgatggtcaaatgaccatgtaatcaggaggttgttagaaacacaggtccggagtatgcatggggtgtcccaggggagaaaaggcttactttggaggcttgctgtttcaactcacatgaagcctgattctacatgaatctggttggagccttgctggcagcgacttttactcatttattcaacaaatgttttttgaatgcttatgattttctaaacaattggttaggtattagaaatgtgagggtaagcaaaccaggtacatccctgatcctcccacgaattacagcctatggaaccaacaactagaaattactaacttggtgaggaaggagaaatagactcagttttctctcaatactctttccaccttaacatcgagaggtttgggttaggcttttaggaatataattctttgtagagcaaatattcaggatgtcatttacattcagacctacattattttggtgtttttgtagatttcatatgttcttagggaagtgaggttgaaaggcattaaaaaccaactatgtggtaggggttagcttgacatttacatattatctcacttaatctacacaacaactaagaagggcatatatgcaatttttatatacttaaaagataaaaaaagacattggggttaaaaatatgtacaagattatagaggaaaaaatgcatactggacactttccagatgtcagacttgtgccatgtctttatgcactatttattcctgccccccaacccccccccaaaaaaatctgcaaagtaagtttcgttaatcttattttacatttaaagaatttgagatttagaaagtttatataatttgatcaaggttatgtagctagccaattgcagaactaaatttgaatccagatatatctgtttggaaaaaagaaaaaagctttgctttttttcagtataggaaactggagaatgcccagagtagaattttattacctgagtacttaataacaagagttacttctcacctagtgcttactacgtgctcagcattatgccaagctagagtgcgtgagcactctctctcttacatgtcctctcccttcctaatatatatgcatatacacatacacctgtataattatttacatgtatgtgtatattttaggcatattttcatatttgtgaaatatgcctgtactgtatatacataattattacaacaatcatggaccatggattagatgttatctctatttataaatgggaaaaccaagactgaaaggttaagggactttttgtcaagagtaaataatattactaagtaagaattgattcggaattggaattcaaatctgtttgacttcaaagtccatgctcgtaaccattaccctatactgccactcacaatacaactggaatgtattaatatgatttctaatcttatgactaagctaataactttaattttccttaaaaaattattgctattccctgttccttaagaaagaagtgtgaagacgtaatagcagtgcaatgtcttgaaggcattctaactcaaggcaaactcacatcgagatgttgaaataatgaggacaattatgtcgacatttaacagaatgagttgaaaattgatagttctatagaatttcaaaatatctgaagaaaaaattaagttgggaataatattgaaatatacacttctgtaatattagctttttataaaaaatagaagaaatgaactttttgtagaaacataataatccaaaaactaggaaagcagaaatttaaaaccgtatcagagaatccaaaaggcatatttgcttttttggacatattatcttccagatggtatcagttgatccttttggatattgttatctaagattattttttatttacgtaacgaaaagcactgattgattgaaaaagaaaaatgtagtcaaatagtttgatcagtcagcctgcaagcctttactgaatttctctcatgtgcaaaaccacataattgagttgcagactgaactgcatgagtgccaaatactaatctgctttttttcttggctctcaagtcaaaattctgtatacacaatacccaaacatctggtcacttaaatccattcagtcaaaaattcaattgaccgcccagattttctgattctaggattccattcaacttgtttgccttaattagttagtttatctgaaagctatgtcaaataggtaatagcatatatttagttatttcaatagtacttggcatcttacatatgaaaaggtacagttatggagggaagaaaacacaggttctgttcctcccacctccatcaagcttttaacagatttaatgttgttttctgccttctatactgtttgccttcctttttgaattggtctcacccatctctcactgccccccactctcgggacccctcagtctccatttctctctcaatttcctaaaagtgacatcaattttccatgaattacctaagaacgacttaccaaaaaaaattacattgttatgaataatgtacgcaaaactgttgatactggctaacttaggggaaagagctttttccatttttaatcttacagttttatatctgttcacattttccaaatatacgtatgaattatttatgtattgccttttagtatccatagaaattatatgggagttgccatcacggaccatttttctttccttctttaaagtttcctatacttaaaataactcataaatataatttctaaagtaagcacaaattctcacttatatatttggttcacaggaataatcagcaggcaatgcctacaactgcacagaataaaaatttttattggctaaaaattagtgggagcatcaaatgtctttgacaaaattacactgtgaaacatttggccagcctaatgagggtttatagaaataatgaccataaaagaaaactatactggcagaaattaatatgagcaaactactgcttaatgagtcccaaatcatcactgtaaagtttcaatgggaaagaattcatgccaattaaaatattttcagagggacacaactggaaatgtaaaatattagaataaatgtaaaatattagaatcaatttatatgtagtatacagaaaatagatcaaggaattaaattgacttaatagcatttagtccagaaaataattttcttcataataattcttcagtattattatatttcattcaatctttgtactcctttgttggggtgcaaatgtcttgaactataactgttttattagcctaaggaattatttgatgaattaacagaagctgtatcatggttctagacattcatgctcaataaactgaattaaatgttaccaactggtaggagaaagtagagaactttatttagttgtggcagtgatagctattatatctttggatgattatagtttttatctctctgatcctttgctgcacaagtaagtattcttttatatttgcaactttttgccatgtcttttacctcacatataaataagtaaatacattgacttccaggtttttaataaacttatagtattctccatttcttttattgtgttttctcatctttctcttactctaaattgcatattcataatcttgtccttttgaaaaatactaaacttatcccatgctcatattttaccccagcactcaaaatacaaattagtaattttgctacccaaagtataatgaagtaaagtagacctgcctcattacaccagtgagaatacctattatgaggttatgattagtgatcacactgtgctctatgcagcgcagcatcctgtgctatattaaaatctcttcactagttgtgttactgtagcacactatatccaaacattgttctgtgttatttttctcttcattttaactgtagtttgtgaaaactcttactttgtggttaagaaggcctgtccagggaagcaagagtcataccatattttaaaaatatacagtttatcagagctctaagcataatgtatcagccacaaacaatcatggcaaagcttcccttttaaacttggtgcttcaagggttgtttatgccttcaaaaatttgctccaaaattactaattcctgttttacactgggaaagttattagtgtgttcaagtagattgatatttagatttaaaaattatctcaggcaaacatatttctatccatctctatggcaatgttttgatggccaatttatgccagattctagagccaaatgtatttgcctgaggtctccagatgttttctgacttgctgctggtgtctgaaaaaacgttgcaactatgactgtaaattcaccctttttgctttactgaactggggctaagacacccatccttcttttcttgtggtttagcttagccagaaatgcaccagagataatttacaaaaggataattatatagtagcttaggaaatttggttgtgaataactaacattttgtaagcttttaaaagttggaaatttgaagatcaactctcatttcatacatgataaaaagatatcaaaaaagtatttgattatacttaagttatctaactagttagcaataggatctgaacatgtgaaattcaccagggaagctaatgaagaagataaggccagaagaaggagaaataatattgtagtttttctttttctggcaattgttcatcatgatagaagaagtataatttggaaagtgtgttttgaggttattatatgaaagaggtggaaaattgcacaaatctgtggcagaaggtccaattatcttgacctcttgagtgtcatttctttattatcagagtattactatttttactgtttcctttttaatcttttaaaactattaattctttcctcagttcctgtcttccttctgtgagagcctctcattattcatatagaatttagccaaagttgacgtggatttttttctccttttaacctttagtattttctatggaaatgatgggccagttatttgttagcttgtaaaaggaggaaaaaacaataaatgtgtacctttatatccccacacctcttctgtattatctctcagaacatattaattttttgaaaataccagatctttaaaaatagtggtacatcttcaggaatatttattttttcatcatttcttctatttgttaccatcctcaagtatgtcaaaaaattagaataaaattattttacctactttgtccaaatatcaagttgtaaatactattcatgtattaaaaagtgaaaaactatgactgttataaaaaatatatgctcacataaacgatcgttttatgtatcattccttgaagttcggcccactttagaaattcacatatagccatgcctccaaactcatcatagcttagaattgttccaactacataatctcaactccaaatgtcttttcatagtcacattacttgttcttctgccactttctattctaccattctcactcatcactgtgatgtataagcctttatccattcttaggtttccagtctattttgagtatattagttttctgtgcctgacataacaaagaaccaacaaactaagtggcttagaacaacagaaatttgttgtctcactgttctggaggctagaatcccgagatcaacgtgttggccgttttatttgaagacatgttttatttgaagacactagggaaggagctgtccaggtctctctactattactagattctggtagttccttggcagcataaaatccaatctttacatggcattctccctgtgggcatggatgtatctgtgtccagatttctccttttcgtttttttgagacagagtttcgctcttgtcacctaggctggaatgctgtggcgcaatgtctgctcactgcaagcttcgcctcccaggttcaagcaattctcctgtctcagcctccccagtagctgggattacagacgcctgccccaacgactggctaatttttggtatttttagtagaaacagggtttcgccacgttgggcaggctggtctcgaactccttacctcaggtgatctgcccacctcggcctcccaaagtgctgggattacaggcatgagccatcacacctggccatttctcctttttataaggatactagtcatattggattggggggtcccccctactctggtaggaactcatattaataattttcaatttgactaattatatcagcaattaccctacttctaattaatgttaaattctgagatactgaggattaggaactcagtatatgaatttaagggggtagggcacaattccatccataataccttcttatctagaaaagaagaatcccattatctcctatctcaacatggctcctatcacccttctaattttattcttgtcttccatcatacagagctacctaagtagaaaattcttgctctggaattgatggacattactggtgaaaattacataatcatggtaataaaatacccattaagaatgcatatgttttgaactcaactgggccttaaatctgtagggatcttgtttcaccatcccctagctatgactgttgcaaatacttgcttttttttttttcaataatttcaacttttattttagattaaggggtacatgtgcatgtttgttacatgggtatgttgtgtgatgctgaggtttgggatacaaatgatcccatcatctaggtagtgagcatagtcactacatttgtttgacttttaactttgctactcttactccaaacagacccctcctttcctaactaaatgaaatgctagaagacatcaatatgaataaatttgacattctttccacacccctccccaacactattctttcttcaaatatcttctctgcctttcatctctcccctttgactggccccagtgtgtcaacaaaacctcctctgtaattaatgcaaaaatgtcattttctttgaaagcttccctctctaactatgctacatgctgctgctttgtttatgatcaaaaaataatggaaagccactctgttgactcttcattgcctaggaaataagaactaaatcctaatcagtaagtacctttaatgtgttctcaagctagttgttgaaacctatattctggtgagctttcaagatggccgaatagcaacagtggtggtctgcagctcccagtgagatcaatgcagaagatggatgatttctgcatttccaactgaggtacctggttcatctcattgagactggttggacagtgggtgcagcctatggagggcgaaccgaagcagggcagtgtgtggcgttgcttcacctgtgaagtgtaaggggtgggggatttccctttcctagccaagggaagccatgagagtctatactgggaggaatgatacactcctacccaaatactgcacttttcccactgtgttcgcaaccagcagaccaggagattccctccggtgcctggctcagtgggtcccacgcccacatagcccagcaagctaagatccatggacttgaaattctcactgctagtgcagcagtctgtgatcaacctggaatgctggagcttggtgtggggaggggcgtccatcactgctgaggcttgagtaggtggtattatgcccacagtgtaaacaaagctgccagtaagctcgaactgggtggagcccaccgcagctcagcaaggctgactgcctctctagattccacctctgtgggcagggcatatctgaacaaaaggcagcagtccagtcagggaattatagataaaaccctcatctccctgggacagagcacctggggaaaggggtagctgtgggcaaagcttctgcagacttaaacatccctgcctgacagctctaaagacagcagtggttctcccaacaccacattcgagctctgttaacagacagactgtctcctcaagtgggtccatgacccccatgtagcctaactgggagacatctcccagtaggggctgacagacacctcatacaggagagctctggctggcatctcatgggtgcccctctgggacaaagcttccagaggaacgatcagggagcaatatttgctgttctgcagcctccgctggtgatacccgggtaaacagggtctggagtggaccttcagcaaactccaatacacctgcagctgaggggcctgactgttagaaggaaaactaagaaacagagaggaatagcatcaacatcaacaaaacggacacccacaccaaaaccccatccatagtcaccaatatcaaagaccaaggtagataaatccacaaagacggggagaaaccaatgaaaaaaggttgaaaattccaaaaatcacaatgccttttctcctccagaggatcaaaacttcttgccagcaagggaacaaaactggatggagaatgagtttgatgacttgacagaagtaggtttcagaaggtgggtaataacaaacttctccgagctaaaggagcatgttctcacccaatgccaggaagctaaaaagccttggaaaaagatgagaggaatggctaactagaataagcagtttagagaagaatataaatgacctgatgcagctgaaaaacacagcacaagaacttcatgaagtatacacaagcttcaatagccaaatctatcaaacagaagaaaggatatcagtgattgaagatcaaattaatgaaataaagtgagaatacaagattagagaaaaaagagtaaaaagaaattaacaaagccttcaagaaatatgggactatgagaaaagaccaaatctacgtttgatcggtgtacttgaaagtgacagggagaatggaatccagttagaaaacactcttcaggatattatccaggagaaattctccaacctagcaaggcaggccaacattcaaattcaggaaatacagagaccaccacaaagatattcctcgagaagagcaaccccaagaaacataatcgtcagattcaccatggttgaaatgaaggaaaaaatgttagggacagctagagagaaaggtcgggttacccacaaagggaagctcatcagactaacagcagatctctcggcaaaaaccctaaaagccagaagagagtgggagctaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaacaatcagtaccagccactgcaaaaacacgccaattgtaaagaccatcaacactatgaagaaactgcagcaatgaacggacaaaacaaccagctagcatcatgaggacaaaatcaaattcacacataacagtattaaccttaaatgtaaaagtgctaaatgccccaattaaaagacacagactagcaaattggatgaagagtcaagacccatcagtgtgctgtattcaggagacccatctcatgtgcaaagacacacataggttcaaaataaagggatggaggaaaatctaccaagcaaatggaaagcaaagaaaagcaggggttgcaatcctagtctctgataaaacagacttcaaaccaacaaagatcaaaagagacaaagaaggccattacataatggtaaagggatcaatgcaactagaagagctaactatcctaaatatatatgcacccaatacaggagcacccagattcataaagcaagtccttagaaacctacaaggagacttagactcccacacattagtaatcggagaatttaacaccctaatgtcaacattagacagatcaaccagacagaaaattaacaaggatatccaggacttgaactctgctgtggaccgagtggacctaataggcatctatagaactctccaccccaaatcaacagaatacacattcttctcagcaccacattgcactgattccaaaattgaccacataactggaagtaaaacactcctcaggaaatgtgaaagaacagaaatcacaacaaactgtctctcaaaccacagtgtaatcaaattagaactcaggattaagaaactcactcaaaaccgcacaactacatggaaactgaacaacctgctcctgaatgactactgggtacataacgaaatgaaggcagaaataaagatgttctgtgaaaccaatgaagacaaagacacaatgtaccagaatcactgggacacatttaaagcagtgtgtagagggaaatttatagcactaaatacccacaagagaaagcaggaaagatctaaaatcgacaccctaacatcacaattaaaagaatagagaagtaagagcaaacaaattcaaaagctagcagaagacaagaaataactaagatgagagcagaattgaaggaggtagagacacaaaaaaaacccttcaaaaaaattatgaatccagaagctggttttttgaaaagatcaacaaaatagacagactgctagcaagactaataagaaaagagataagaatcaaatagacacaataaaaaatgatacaggggatatcaccaccgatcccacagaaatacagtctaccatcagagaatactataaacacccctttgcaaataaattagaaaatcaggaagaaactgataaattcctggacacatacactctcccaagactaaaccaggaagaagtcagatttcttaacagaccagtaacagtttctcaaattgaggcaataatagcctaccaaccaaaaaaagtccaggaccagacagattcacagccaaatttaccagaggacaaagaggagctggtaccattccttctgaaactattccaatcaatagaaaaagagggaatcctccctaactcattttatgaggccagcatcatcctgataccaaaacctggcagagacacaacaaaaaaagagaatgttaggccaatatccctgatgaacattgatgtgaaaatcctcaataaaatactggcaaaccaaatccagcagcacatcaaaaagcttatccaccatgatcaagtcagcttcatccctgggttgcaaggctggttcaacatatgcaatcaataaatgtaatccatcacaaaaacagaaccaaagacaaaaaccacatgattatctcaatagctgcagaaaagaccgtcgacgaaattcaacagcccttcatgctaaaaactcacaataaactaggtatcgatggaacatatctcaaaataataagagctatttatgacagacccacagccaatatcatactgaatgggcaaaaactggaagcattccctttgaaaactggcacaagacagggatgccctctctcaccactcctattcaatatagtattggaagctctggccagggcaatcaggcaagagaaagaaataaagagtaatcagttaggaagagaggaagtcaaattgtctctgtttgcagatgacatgattgtacatttagaaaaccccatcatctcagccccaaatctccttaagctgataagcaacttcagcaaagtctcaggatacaaaatcaatgtgcaaaaatcacaagcattcctatacaccaataatagacaaacagagagccaaatcatgagtgaactcccattcacaattgctgcaaagagaataaaatacctgggaatccaactttcaagggatgtgaaggacctcttcaaggagaactacaaaccactgttcaatgaaataaaagaggacacaaacaaatggaagaacattccatgctcatggataggaagaatcaatatcgtgaaaatgtccatactgcccaaagtaattcatagattcaatgttatccccatcaagctaccactgactttcttcacagaattggaaaaaactactttaaatttcatatggaaccaaaaaagagcccacatttccaagtcaatcctaagccaaaagaacaaagctggaggcatcacactacctgacttcaaactatactacaaggctacagtaaccaaaacagcatggtactggtagcaaaacagatgtatagaccaatggaacagaacagaggcctcagaaataacaccacacatctaaaatcatctgatctttgacaaacctgacaaaaggaaaaggattccctatttaataaacagtgttgggaaaactgactagccatgtgtagaaagctgaaactggatcccttccttacaccttatacaaaaattaattcaagatggattaaagacttaaatgtaagacctaaaaccataaaaaccctagaagaaaacctaggcaataccattcagacataggcgtgggcaaagacttcatgactaaaaccaaaagcaatggcaacaaaagccaaaattgacaaatgggatctaattaaactgaagagcttctacacagcaaaagaaactatcagcagagtgaacaggcaacctacagaatgggagaaaatttttgcaatctatccatctgacaaagggctaatatccagaatctataaagaacttcaacaaatttacaagaaaaatacaaacaaccccatcaaaaagtaggcaaaggatatgaacagacacttctcaaaagaaggcatttatgcagccaacagacatatgaaaaagtgctcatcatcacttgtcattagagaaatgcaaatcaaaaccacaatgagatactatctcatgccctcatgcctgttaacatcatgatcattaaaagtcaggaaacaacagatgctggagaggatttggagaaataggaatgcttttatgctgttggtgggagtgtaaattagttcaaccattgtggaagacagtgtggtgattcctcaaggatctagaaccagaattaccatttgacccagcaatctcattactgtctgtctacccaaaggattataaatcatgctactataaagacatatgcacacgtatgtttattgtggcactgttcacaatagcaaagtcttggaaccaacccaaatgtccatcagtaatagactgcataaagaaaatgtggcacatatgcaccaaggaatactatgcagccataaaaaggatgacttcatgtcctttgcagggacatggatgaagctggaaaccatcattctcagcaaactatcacaaggacggaaaaccaacactgcatattctcactcataagtgggagttgaacaatgagaacacatgggcacagggaggggaacatcacacaccagggcctgctggggggtcggggcttgggggaaggatagcattaggagaaatacctaatgtaaataagttgatgggtgcagcacaccaacatggcacatgtatacctatgtaacaaaactgcatgttgtgcacatgtaccccagaacttaaagtataataaaactatattctattgaataaacctttttgaaccataatatggcattaaacattccagattattgccattctgtacattgctatctctttaccatattcaccaagtttaccttagccatgttgttaattggtttgttatatttatattaggttttgttacgtttatattttgtttattttcttattctatccatctttcttggccagctcaaatcctaagaagtcatctccaacactcactatctccttagtagcaattacttccttcttccttaggaaactgataactttgtcacaatttactgttggtatttaacatattgtaacttgcaaataaattgtgtgtgtaaattcctgtgttgtatgtactaggctgtgagaactttcctgtttgggactatgtcctgttcatctttgtatatcatagtgcaaggaatttattatttgtgaattaaacagatttatcaatgtagaaatatataaaattctgcagcaaaatatggaaaattatatcctgatatacgtttgttaattctttattcatttttcatacattggttttacatataaaatattatcaagacactaccatgtgcttaatacaaggtactaaataaactgaaatttattttataatttaattctacaaataaatccactctggtagcatttggggaatataatattgactttatattttaaaataaaaatatgaaagtttattttattttattttattttgagaaaatactggcaaattagaaaatactggcaaatgtttttgcacgtggtctcttaagaaccatagctcagaaccctgggatgtgatacagtactattcacatcagtactactcagacacattgaaaacctggtcctgtgtcaagtcccatgaagggaatccctaagggaatagagaagagaatgctatttaatgatttgatgcatgatagtaaccacaggagaataaaacttcgaaagagtctttataaactgggtttaatgaaactgatcatttccagttctattgtatatcatttactgccttagctggcaagactctagaaatagaaatagagaagattcttccttctcatatgtgtacattttaatatcttgaatatagaggactacttatagaattcagtgaagtcaccaaaggttgaataattagctatttctgccctttactagttgttagatttaacattatcaacctttgcagtgaaaagtagaaaaaatacaaactgcaccaacagttgggctagtcatacattttacacagtgacaatatcccattaaaatggtattcttaaagaggagatgtgtgaattaatatgcagtggcacatagaattaaccaggcatcatcattttatttcagaagcactcatatgattaaatttctgagctaaaaattcatccttaaaagttatactttagcagaatgactgattttattttatagctgtcaatttgattgacaagtaggatccatcaagtgtgtttctattcttgtaatccagggacaccttgaaaagatttcgcaagagaaaagaaagaaatattatagaaaaaaaaaaggaaatcgcatgtctaattaagagcttaatttgtgatgaaaatacataattttttttttacatccactatggtgctaaaacaactacactggaaaaatcccttagttatggggtaattggtatgaatcaaatatctttcttatttagaaaccatttatagtgctgaattcatttcatttatagtagtgtcattttgtatttttatgcagtttgaattggtactgttttctaattgcagcaaggactttactgcataataatttaaaattttagctttgtaatagctcatgaaaatattcaatattttgttttgttgtgatggttaatattaggtgtcaacttgattggactgagggatgcctagatggctggtgaagcattgtttctgggtgtgtttgtgagggtattgccagaggagactgacatttgcctcagtgagctaggagaggaagacccaccctcagtgtgggttagcatcatccaatcagctgccagcatggctagaataaagcagggggaagaaggtgggataagctggcttgctaaatctgccggctctttttcttttgcctgttttggacacttgcttccactcttctgcccatagataccagactccatgttcattggcttttggaatctgtgacttgcaccagtggcttccccagggctgtcaggccttctgcagcagactgaaggctgcactgtcagcttttctggttttgagtctttccaacttggactgagaaattataggcttctctccccaacttgcagatagcctatcatgggacttcaccttgtaatgatgtgatccaattctccctaataaactctctcctatgtatacatagatccaattgtttctgcccctctggagaaccctaatacaatcatatttactggtgtatttagtgctagatgtttacatgatataatggtgtgagttctcaagaatctgagataaggtcttgggtgtaggtagtttacttggaaggagatcccagggtcaggaatgagagtgaagagtgagaaggaggaaagggcaatgtacgagtacgttttcaaggtcatgcctctgtgagcaatgtggactagattccactggggattgctcctaagaggcatagagaatacctcttaaattatctgtctagggaagagcaggcaagaacatatatccactggttcttctatattggttaacactccaaggacattaactccttctcacttccaggctgcattaacttacctcaaggcaaaaggtgatcagtatagaacaagcctaaaagctcctaagaacagtccagtagctatggctgaactcagaggtgggtgcagaggctgtgaggtggagcagcagagggattctgttaggcaggggttatgtaacatgattgattccgcagcccaaaggagaacttgacacccaaatagcaccaaaaacaatagatttcaaatattttctcttgtggacaatacatacattacagttatttatgtgtcgcttaatgacagggatatgatctgagaaatgaatcattaaatgatttcatcattatgcaaatgtcacagagtgcacttacacaaacctagatggtacagcctgctgcaaatttaggctacctgatacagcctagtcctcctaggctacttaacctgtaccggatgtgactatactgaatactgtaggcagttgtaacatgatggtaagtatttatgtatccaaacaagaaaaggtatagtgaaaatacagtattataatcttaagggattgccattgtatatgtgagcccatcattatccaaaatgtcattatgtgacacatgactgtatatgattctactgggcatacagagacaaaaatttatgaaataatacccttgctgtgcacaatgaggtctgatgttttctattctgttctacgctgtgttattctgttctatttaattaaacactgctcttcataactccctaaagtaatttttaaatccatggtttggaaaacattggccgaaaagataattaatttacctaagaaggtaaatattagcgtattaaaaataatggaaatcatgtaacctaagccatatacagtgagatgtttagaaataaaggtcatagttttaaggtcaagaaagactcaattcttaagaaattagaaaatagagtagcatggtttaaatgtgtaccatggttctagatttcatctgtcagtgtttcagaatctgcaaatggataaagaacatctagctccctaagagaattaacagggagggaacacagaagggctgaaaaatgaggtgctgttctccttcttttacctcagctgctgtgattcctgctatcccaattcatatacatatagtgaggagaattcgtatatacagcctgtataagtatgtgtacatatacacagccagctagatgttaccctataggtagagcttcctagtgccctatctcaggatccttttgcatcttatgtttgtttcaggttgttttgacagttgtcacttttaagcttcttttctcttttcatagagaaagagctttcagtctcctaagaggatagctctattatcataatcaccttttagaagagaaaattacctgtaatttttatgctctgaaggtgtgtcatcataattcagccacccactttaccctcaaaatcaaatggatttttttaaagaaacttctttattctttcttattgcattttctttggaggaaatgagagcttaagaatatgggaaatcccatcaagtttctatgagctttgctgcctctttctactgtcagctgttgtgtttaaggatatcacagccacagtgatctgcaagcactgctgttgtaagacttgtctcaacagagtacagtttaaagagtaagtgaacaagtaagggaatagtaaccctcacacaagccataactttccatcagatccctcatgcttacaagctccacctttgctgttgtgtacacagctcctcctggaagcccgacctccccatcccaccccagcactcctgtaaatctgtctcatgggaaagataacacaggagtgtgtgctcacaggttaccaatcaatatcaatatttcaccaaatctcagttgtaattgattatcttccagttattggagaataaaccccaaaaggggtggataaagggaaaaaatgcaaaaacccagaatgtcatgtgccttttgccagctactgctggatgtgttctacaactgagtacacagctgtttctaataaacactattagtactaatccttaagcagttattgccttctcctcattgcagtagatcctccagtatagcaatctgaaaaactgacctcattgtcaagtcaattggtgtcttgtgaaatgacaatttggtggtaaagtaactttcgcaaagtgttgcctactacagattctgaaaagtatcaaggttaaaaaatttatttaacttttcaaacctagaatttctcacatttattatttcatgggccgggcgcggtggcttacgcctgtaatcccagcactttggcaggccgaggcgggcagatcacgaggtcaggagatcgagaccatcctggctaacacggtgaaactccatctctactaaaaatacaaaaaaaatagctgagcatggtggcaggcgcctgtagtccgagctatttgggaggctgaggcaggagaatggcgtgaacccgggaggtggagcttgcagtgagccaagattgcgccactgtactccagcgtgggcgacagagcgagactccatctcaaaacaaacaaacaaaaaaaacccacatcttttgattcttaaaggacagtgactatttgcacaactcagtatggaaaataaggttttgcccagcgtgccattttttatcacgtgggtgcctttacactcctttttctacgatgctttctccaagttcccttggaatattctctcatcccttcaaatgacagagcttcctatgccagataatttttttattgtaccaccaatgtcaacctcagtgacattggccataaactacaaaatcatggctatatgtatatgcaaataaaaaatgtcacagtactgattttttatttttgtcccttgattcacttggtgtctcggtgtgacttttcaagccccagaggagtgaactccttttctcctttcctgtttccatccagctggttccagatcagcatcaaagtgaaacggatttgggtactgaaaaggtaatgagcttcacttatagggagaaggaaaacagaggatacagctatgcatattggttattacttacttccttgagtataatccttattcatttattcaaatatcatcatcatccttttgtttgtagtagtactggtagtttgttgagactctactttgtcccaaatattatttagagcatatgtaaatgttaattttttcagtcctcacagaaaccctataaagtatgtctcacattcttcactctacaaataaaacaggccaagaaaaatgaagacacttgccccagtcacatggtaatatatggcagaaccaaaaatcaaacttaggtcactttagttcaaagcttttttttttccctccactatgagctactgctctccaggcttgatcatctcttgggtgctagccactgatatgctccccagattccagtggctttcattcatggcttctacttcaccaggaagtgcctgtcctttagccaaagagaaaatacttttgtttttgccccagtttttttgtcctggtagtggggctaaagatggaaattcgccatttgtttctataatagatactgataaggaccaccaaaatgatggaaaatgtgcaagcttcaaagcaaaagcctacaagaagggagtataaactgaaaaagttacattagatagcacagatttgctgggctcaaaatatatccctctggctgtcattagcacagaactatagtaggatttaagaaatgtttgaagaattcatggcaaaagataaaatgtgttatccagttgcaagacatcatagagaccatgagggaccacatttgcaaatatagttcattctgacaacagttgtgtgtgcatcttaggacagtcattacatatggttagtcattatttatggaatatctattgtatacagatgggttggtagttaagaaggaaatattctttagctcctgttgctacaaaataaacattgatcagtgtttacaccatgccaagaaagtatttgaatattaaaatctcaattcactaaatggtggtatgtggcaacaaatggtaattaaaataaatatttgataggtttttattgtttaaaatgggaggcaatttagtgagagttataatacacagtggtataataaaatggctaataaatttcactgttttttaagaagtggagaaccaattagacaaagtacttctcatttattttttaagagagaaagagagtgtgtgggtgtgtgtccattcacacatgtcactacacattaccctagaacactgtggggtttagtaagacccttttaaatatagaatgccattaaataaaaatacagaaactagttttcagtctaaatatagtaatatagtaactgcttgttgcacttattgtgaatatttcagaggataaaccatggcaaatcgttcaatcctttccttttttctgtactttgttaactcatggtaaatttaacctgtttttctctcttaaatctaataatttttattcttttccttcataattaacagtgttttagatagtattttaaataattttatacaaagtagtttacactcacaagattttttttaaaattcaaaatatttgatgaggcagccttttcagaaatgtcaaagtagtaatgcttaactaaagtatatagcagtttaaggacaaagagaagtcaatcattatccatgttgacaacatgagtacccaccaaaatataatttttaatgaggtacacaattagctgcttttatatggatcataatataagttctgccccatcccccactccatcattctatgatgacaaattactatttttgaatgttggggaagcgctagcaagctctttctttgttcactcagtaaaacaggttttatatggctcttcaaataactcctaaaacaaacttattataagacatgacaagtaaaccttcctgcttattacttttcataagcacatcttcaaaaatgtccaaaaaaatgtaaggtcaaaaggataagggtggggaaagcttgtacaagataaaagttaaattctttgggaaggcaaccattccgatgatttaaaaagcatttatgtaacatggtgaaaccctgtctctactaaaaatacaaaaattagccgggtgtggtggtgggtgcctgtagtcccagctactcaggaggctgaggcaggagaatggcatgaacccaggaggtggagcttgcagtgagctgagattgcaccactgcactccagcctgggtgacagagcgagactccgtctcaaaaaaaaaaaaaaaaaaaagcatttatgttgatgattgatgagacacagaaagatatttgctatactagaagtttacagagtttctcatatcctcctcaactttcttgttttcagtactcttttcaattaggaatgataggaaactgtatttcttttccttgatggagtaacaaagggtgataggaatactccttatttaataatgatgtatgttatacatccatggtcttcttggtcgttcattcctgagctagtttctaaattagaacttgattcatctaaaaatggggtggattcttaaactagggacttacaggaaaaggcaaccttttagttttctgcatattgtattcaactctggaatcttgtgtccagttctgggcatgttcatagatttaattcatgtcaacaaatatttactcagtgccactttatacataaaacactaccctaggactttggttgtccaatcaagatcctatcacattctatattatgcaaataactagactttttacaaactgaatggctttccctggcctcagtgtatttacaaactagtagaagagacaaatacagaaacacataattaaaatacagaaaaataaatacaaaattagtatatggatagcatatgaaaggtaaaggaggtcccaatcccgccctctagtcatggaaaccacgagttcgttattaatacaaagtcaatggagggtaattgagtgacaggaagagagacaggtgctgggcagaaaccacatcagtgcacttgtgacattttatttaatggtaaattctatcatattcatggtaattgcctgtgactgcaaaatgaggaaaggttacatgtatttgtcttctcatcattatcaccactgtaaacttttttctaaatacccatatgtgggtggagctaatagaagccccacatttttgttagaaccattgtggtcacctgagaactcgtgacctttttcaagcgggaaggtacctctctggtagctttatgtattatgaatttgaagggacaagcttgggaacagaaagatcagttaggaggtgaccataggagtcacgtgaaagctgacaaaagcctgagctcaggcagtagtgttacagataaagaagaagagatggagcaggattcaaaaatatatatgtatataaacttacttgattagatgaagtacatgaaggaataaaagactactcttaggattatagcttgggtagtagcaatttagtggtgtggtactatgacattaatgggaacccactgaacatcaaaagaatatatttatacttttccatattagcaaaacctaaagaagactcagattaataggcaaataccaaacaaaaaaatgaagagggtacttcagaagtacctgtttacttattgaaagtagtatctgtttactcattgaaaattcatccatttgaaagcgtttacaatgttggtgggagtgtaaattagttcaaccattgtggaagacagtgtggcaattctttaaagacctagaggcagaaatatcatttgacccagaaatcccattactggatatgtacccaaaggaatataaataattctgttataaagatacatgcacacatgttcattgcagtactattcacaatagcaaagacatgtaaccaacctaaatgcccatcattgataggctggataaagaaaatgtggaacatatactccatggaatactatgcagccataaaggggaacaagatcatgtccttttcagggacacagatggttcctggaagccattatccttagtaaactaacgcaggaacagaaaaccaaataccacatattctcactcgtaagtgggagctgaatgatgagaacacatggacacatgaggggaacaacccacagtggggcccttcagtgggtagtgagtggaatgagggagagcatcaggaagaatagctaatagatactgggcttaatatctaagtgatgggatgatctgtgcagcaaaccaccatagcacatgtttatctgtgtaacaaacctgcacatcctgcacataaaagttggaaagaaaaaaaaagaaaattcatccatttgaaattcatgtgctacttttttctccccacttattatttgattttgttgagtgtattttgataacaacatgaactgtgaataaaatggcatgcaattgaaaggcagtaattgctaggtaagtaatactaagtaggtatagtggggtcatatttttaatcaagtgataaatagttggagagaacaaaaatgaacagccttgttatacatgcaaatgtcataacttcattcagttttatctgtctagctgtatgcactatgtggaagtgaatgcaagtcaaattcatgaagtaattatctagattaagaactaaaaggattcagtgcacttgattgttgacattttatttaatggtaaaatctatcatcttcatgataattgcttgtgactgcaaaatgaggaaaggttacatgtatttgtcttctcatcattatcaccattgtaaacttttttctaaatatccatatgtgggtggtgctagtagaatcaccacacttttgttaaaagcattacgtttgctttctccaggataattctgacaacaatagtacaaaacttatcatcttttattttggtcccttacctcctctatttccaataatttattggtgtctaatgtaataccataacctgttctcccaagctccatttctgtggttattttctccttttccttcttccttctcctttgatacacaataccatcacatgttgctgatctttccactgcactgccttttttgttcaataaaaatgtaaggtccccagctcacatgtatgcttcagtgtgcagctccagagctgctgtccaatatggtagccactagccacatgtgactattgaatactttagatatggctagtcaaaattgagatgtgctgtaaataaaaactacataccagacttgaagactttctccaaaataagaatatttaaaaagtcattaatgatttttaatttgattacagtttgaactgataatactttgaatgtattaaataaaatgctatttaattagttggacttttttgtttttaacatgcctattagaaattttgaaattgtgtacatctcctacatctgaggcctacattgtttttctattggacagcattgcaataaaggacactagagttaaagagggcatgctctctgctccaagactgtgcagctagactaactataatatcataaattggagccaggcttggtggctcatgcttgtaatcccagcactttgggaggccaagacaggtggatcacctgaggttgggagtacgagaccagcctgaccaaaatggagaaacgctgtctctactaaacgtgcaaaattagccaggcatggtggcacatgcctgtaatcccagctactcaggaggctgaggtaggagaatcacttgaacccaggaggcggaggttgcagtgagccgagatcacaccattgcactccagcctgggtaacgagctaaactctgtctctaaatacatacatacatacatacatacatacatacatacatacagtgatatggtccataggagagtgtaaagagaagagtgagtaaacatttctaacagggcatttgaggaaagatccatggaagaagtgatattgaatcatcatagaaggagggcaatggtgttagcatttcaagtacagaagacagtgtaagttaagtcttggtgacaagaaacaggctgctgaaacagtcacctcaaatattattttatcacatcactgctctatggccaaccatagaaaaataaaaatctatccagaaaatattttaagcttcttaccagtttttcttaaaagcatctgtttctacttccttacctactcccactgagaaaaaaaggttcctctcaggccgggcatggtggctgacacctgtaatcacagcacattgttgggaggccaaggcacgtgggtcacctgaggtgaggagtttgagaccagccagaccaacatggtaaaactccgtctctactaaaaaatacaaaaattagccggacatggtggtgggtgcctgtaatccgagctacttgggaggctgaggcaggagaatcacttgaacctgggaggcggaggttgcagtgagctgagatgtgccattgcactgcagccggggtgacagagcaagactccatctcaaaaaaaaaaaaaaaaaaaagtgcctctcaatgaggtgtaaaggtagtggtacttacggcagactagaaagatgctatgtcagtcgtgctgctagggacctctgaggagctaaactctggttttagctactgaaatgggaaagaagtagctcgcctgtacccatgcttaactccaggagggaggggaaacacaagagtaacacttcccaatagtatgtctcctgagaattgggatatcttatggttcaccataaagtatctgttgagtaaggaaacatgaacaaaggaaaaagaggcagatagaaatgaagaaagtagggaaaatcaattctaaaagacatgttttatagataataagaaactaattaggagcataaaagagaattgagggttatagctcaggcagtgcagtatcctccacaggtttgaattcaggcactggcctgtgctgcccttaggttgtaggcaagctgcttaccctctctgactttcaattccctaatctgtaaaaagtaaagtctaagaattagaaacaaggtaaaacatagtgtctggcactctgtaagtgttaaataaatgttaattttatgttcgaccactgtttgctaaataattttgaaatgtatccttttttggttgattccctgggaattcagttaggaagagaggaagtcaaattgtctctgtttgtagatgacatgattgtatatttacaattgtctcggcccaaaatcttcttaagctgaaaagcaacttcagcaacatctcaagatacaaaatcaatgtgcaaaaatcacaagcattcctatacaccaataatagacaaacagcgagccaaatcatgagtgaactcccattcacaattgctacaaagagaataaaatacctaggaatccaacttacaagggatgtgaaggaccttttcagggagaactacaaatcaccgttcaaggaaataagagaggacacaaacaaatggaaaaacattccatgctcgtggataggaagaatcaatatcatgaaaatggccatactgcccaaagtaattatagattcaatgctatccccatcaagttaccattgactttcttcacagaattagaaaaaaactactttaaatttcatatggaaccaaaaaagaacccgtatagccaagacaatcccaagcaaaaagaactaagctggaggcatcacactacctgacttcaaacaatactacaaggctacagtaaccaaaacagcatggtactggtaccaaaacagatgtatagaccagtggaaaagaaaagaggcctcagaaatattgccacatatctaccaccatctaatctttgacaaacctgacaaaaacaagaaatggggaaaggattccctatttaataaatggtgttgggaaaactggctagccatatgcaaaaatctgaaactggaccccttccttacaccttatacaaaaattaactcaagatggattaaagacttaaacgtaagacctaaaaccataaaaaccctagaagaaaacctaggcaatacccttcaggacataggcatgggcaaagacttcatgactaaaacaccaaaagcaatggcaacaaaagccaaaattgacaaatgggatctaattaaactaaagagcttctgcacagcaaaagaaactatcagcagagtgaacaggcaacctagagaatgggagaaagtttttgcaatctatccatctgacaaagggctaatacccagattctacaaagaacttcaacaaatttacaagaaaagtacaaacaacccatcaaaagtgggctaaggacatgaaagacacctttcagaagaagacatttatgcagccaacaaacatgaaaaaaagctcatcatcactggtcattggaggaatgcaaatcaaaaccacaatgagataccatctcacaccagttagaatggtgattattaaaaagtcaggaaacaacagttgctggagaggatgtggagaaataggaacacttttacattgttggtgggactgtaaattagttcacccattgtggaagacagtgtggtgattcctcaaggatctagaaccagaattaccatttgacccagcaatcccattactggatatatacccaaaggattataaataattctataaagacacatgcacatgtatgtttattgtggcactgttcacaatagcaaagtcttggaaccaacccaaatgcccatcaatcatagactggataaagaaaatgtgggacacatacaccatggaatactatgcaaccataaaaaaggatgagttcacatcctttgtagggacatggatgaagctggaaaccatcattctcagcaaactaacacaagaacagaaaaccaaacaccgcatgttctcactcataagtgggagttgaacaatgagaacacagggacacagggaggggacatcacacaccggtgcctgttgtgagggtggggagctaggggaagggtagcattaggagaaatacctaatttagatgatgggttgatgggtgcagcaaaccaccatggcacgtgtataactatgtaacaaagttgcatgttttgcacatgtaccccagcacttaaagtataatttaaaaaaagaaaaagagatggtccactctaagagaagtggagccaccaaatctaccttaaaaagaagtaatcaaaaacctcaaatgaataagcattctaaagtggatatactatctaaagccatacaattaactagttaactatcacgggggagccagagtaagtatgttaagttctcttctattcattaaaccactttgagtgtaccatctgtttcttgctgggatactgagtgataaaactgataaatttttgttctttttttgtacttgttttaaaaatcaaaatgtgcgtctacaatgaaaagcaatgacagtttgagttaccaaagtgctaagggatttgctactaggatgggtaccaacaatgttagtaaagtcagtggagctgccctctgtaggctagtcctgccctccatagacaaaagatactgctgaaggactggcttccctgagagcaatgtggtggtatgctccccagatgaaagagactgtctggtagcacctgatcatcagaaacaagcaaaatgcaatgatcactgtaagtgtcacgtttggagataaaaggcaatcctgtactttctacctttaaaaactacagactttaaaaaaaattgaagacacacaagaaatggaaagatatttaatattaatggatcggaaggatcaatattattaaaatgttcatactacccaaagcaatctacagattcaatgcaatcactatcaaaatactaatgacattcttcacagaaatagaaaaaataattctgaaatatatatggaaccataaaagacccaaaatagccaaatccattatgagcaaaaagaataagactggagaaattacattacctgacttaaattatactacagagctatggtaaccaaaacagcatggtactggcataaaaatagacacataggctaatagaacagaatagagagctcagaaataaatttatacatctgtagttaactcatttttgccaagggtgccaagaacatgcattgaggaaaggatcgtctcttcaataaatggttctgggaagactggatatccatatgtagaaaaacgaactggaccactgtctctcaccataggcacatcaaatcaaaatagattaaagatttaaattcttagacctcaaactatgaaactactaaaaggaaccattgtagaaactctgcaggacattggagtgggaaaagattcaattagtagtagctcaaaaacactggtgaccaaagcaaaaatggaccaataggatcacatcaacttaaaaagcttctgtacatcaaaggaaacaatcaaaaaagtgaagatacaacccacagaatgggagaaaatatttgcaaactatctatctgacaagggattaaaaaccagaatatgtagggagctcaaacaactcaataggaaaaaaaactaataatttgattaaaaaatgagtaaaagatctgaatagacactactcaaaagaagacacacaaatggaaaacaggtatatgaaaaggtgctaaacatccttaatcatcagagaaatgcaaaacaaaactaccatgagcatctcaacctagataaaaatggcttttatccaaaagacagatgacaatgaatcctgctgaggatctggagaaaggggaaccctcatatgctgttggtgggaaaataaattagtacagttctgttggagaagagtatggaggttccccaaaaatctaaaaataaaactaccatatgatccagcaatcccactgctagttatataccccacagaaaggaaatcagtatattgaagagataactgcactcccatgtttattgtaacgctagtcacaatagccaagatttgcattcaacctgtccacagacaaattaataaggaaaatgtggtacatatgcacatggaatactattcagccatgagaatgagatcctgttatttgcaacaacatgaatgaaactggaggacattatgctaagtgaaataagcccagctcagaaggatgactattgcatgttctcacccatttgtgggagctacaaattaaaacagttgaactcatggagatagagagtagaatgatggttaccagagactggaaagggtactggaaaggagagaggaaaatggggttggctaatcggtacaacaatatacttagatacaatgaataagatgtagtatctgatagcacaacagggtgactagtcaggaataattttttgtacattttagaataactgagggaatacaactggaatctttataactcaaataaatgattaatgtttgcagtgatggatatctcatttaccctgatgtgattattacacattgtatgcctgtatcgaaatacttatgtaccccataaatatatataccttctatatagccataaaaataaaaaattaaaaaaataaaaattaaaagaaaatactaggagagtattttattccatcaattctaaaacacacctttttccttcctgttgtttaaaatcactgaacccaggatatgtcttaccatatttgaagaaagaccatgggtcctagtgattgcaaacattcttttgctcatcttccgctaaaatcgagatgttccaacctcaaagcctgaagagtgaaacctcttaagaaatattcttgatgtcccagagaatgaaacaggtgggaaaacatggacaacaatacctccaacttgaaaagtgattcagaagagttagaccctgaaaatgaggaactttggcaataacttcacagcattattgtgcttatattttctttttatgtgtgactagaatgaatataataaaaaatatatctaaatcagtcaaatattttagcagttgttaaaggaaatactaagatatgcaaacatgtcatggtttaattttttcctggtggtacacaaaatactcataccttttgctattgatggagtcttacattctatgaaatacatttatttttttcaaacctattgtaaaagggtacataaaagataggacagagcaacaccctcaagtttgtaggatattcttatatatccttaggccaaggcaggctaagggcagaggcatgaggtaagcaaaatatatctttgattttgactttctgttctctctcaagtagagagaagcaggtcagtgtaactaaagggcaaagaatttggagtgcagtttagttcttgctccagtggttgctggtatgtggatgtgtgtgggtcatgtcaactctgtgttttttctgaggatactgataaggttcattaaaagtgtatttgaaaggtgccataaaatactattaaatcattctttcttctttgcctgttttacaaacagaaaagaaactcagtatagtttgtctcaagggagattactatattgttacctattcacatccacagtcatacactgtgactaaccagttatagcctacagtctacatgtggccaaatgtttcagagtctctaggagatagaggaatgctcccctaggaggagttgaggaatgcattttcaagagaggactgataatatttctaagagagattccctgattgccttcgatatccaagtttgggcatctcattgccaaggttccttctcctggcctgcttcctcagtctttctccccagctgttgagggctgtattccctgtccaagctcctcctcctttccaaattagttccaatcagttcccctggcctgtccccaccactcggtcagctcgctcagtacttctaaacctcatgtgtctgctccgtatctctgttcttcagagccagtctttctgtatcttcagtctagtaagtgctgctttcataaactagacttaaaatttcatcgcattttaataaaaagtaattactttatatatgatctttaagcagctattctcttaaagaggtactaaatggtgagactttctggtaagggaagaagagagaatgatgccttgaccagtgtttgaggagttaacttcttgagaaaatattgcttacagtctggtaccaacatattattggcagtaatattcattaaacattgttagcatattcgtagtctctaaacaatggctttcaaatattttgactacaactcataataaatacattttacatcctgacccagagcacacatatatgtttatgtatataaaaagtacatctaactaaaaaagattcatttaaaaaaataaaactcctagccttacaactcactaaaagattgcaaccagcagtttaaaaaaccgtgatacataacatgtccttttggcaagtttgaacagcaatgtgtttggtggtttatgttactcgctggaaaacaagcgtttttgaaaccattatagtgttgaaagaaagtataacaaataatcttagattacagttgtctgtgattattccaaatctgaattttccattcctgtgttatttttctcagggactaaatttctaaatgtgattttgtagcagatgaatgagacagggaaagtaaggctattgtttttatgaaatctaggctacattttattccaatcttgtttctgatatcttttctcttaaattgatgttatcattcagcttccattaagaaatgacttctgcatccatttgccttgtgtgtatatgttcacaaatgagtcaatcatatttcattccttaatttctgtagtgagaaaaactgtccatcctaaaggaagaacttgaagaatttcttgctctcctaatggtttttcactaaatccaattctactaaacatgtcattgttaggaataacattttgttttgttttatttcaaggatatgcttcatcatcatcattaccaccatctaaatgcattgttggcagtatggaaaggcaacaataatctttaacatttaaatattttctagtaggttacagatgcattaaatattccattttgtcttagtgaacaaattcaataaatgaggctaaatgtcttatgaagctaactttatgtacttaaaattgaagaatatgaatataaaaatatactatatttaatccatctttagttaatttttgtaaggaagaggtctagtttaagtcttctgcatatggctagccagttatcccaacaccatttattaaatagggagtcctttctctattgcttgtttctgtcgactttgtcaaagatcagatggttgtaggtttgcggcctgatttctgggctctcttatctgttccattggtctgtgtgtctgtttttgtaccagtaccatgctgttttggttgctatagcaggtagtgtgattcctccagcttggttctgtttgcttaggacttccttggctatttgggctctttttggttccatatgaattttaaaatagttttttgtaattcagtgaagaatgtcattggtagtttgataggaatagcattgaatctataaattgctttgagcagtatggctattttaacaatattgatttttcctatccatgaacatagaatgtttttccatttgtttgtaccatctctgatttctttgagcagtgttttgtaaatctcattgcagagatcttttacctccatggttaattgtattcctaagtaggtagtttatttatttatttatttggtggctattgtgaatgggactgcattcttgatttgggtctcagattggatgttgttggtgtataggaatactattgatttttaaatattaattttgtatcctgaaactttgctgaagttgtttatcagatcaaggagttttagggtagagactatggggttttctaggtatagaatcatattgtctgaaaacagggttagtttgacgtcctctcttcctatttggatgccttttttttctttctcttgcctcattaccctggccaggacttctagtactatcttgaataggagtgttgagagagggcatccttgtcttgttccggctttcaagggaaatgtttccagcttttgcccatgcagtatgatgttgattgtggatttgtcataggtggctcttattattttgaaatatgttcattcaatgcctagcttgttgaggtttttaacatgaaaggatgttgaattttatcaaaagccttttctgcatcttttgagttaaccatgtggtttttgtttttagttctctttaggtgatgaatcacattaaaggcataaatgtataacctaaaactataaaaaactcaggaggataacctaagaaataccatttcagacataagactgggcaaagattttatgaggaagatgccaaaaacaattgcaacgaaaccaaaaattgacaaaggagatctaattaaactaaagatctgcacaccaaaagaaactatcaggagagtaaacagataagctccagaatggtagaaaatataaggtctaatatctggaatctgtaaagaacttaaacatatttccaagccaaaaacaaacaacttcattaaaaagtgggcaaaggacacaaacagacacttttcaaaagaagacatacacatggccaataagcatatgaaaaaatgcccaacatcactaatcattagagaaattcaaatcaaaaccacagtgagataccatttaacaccagtcagaatggctatgattaaaaagtcaaaaaataacagctactggcgaggttgtggagaaaaacgaatgcttatacactgttgatgggaatgtaaattagttcagccattatggaagacagtgtggtgattcctcagagacctaaagacagaaatatcattcaacccagcaatcccattactgggtatatacccaaaggaatatacattgttccattataaagacacatgcatgtgtatgttcactgcagcactattcagaatagcgagatatagaatcaacctaaatgtccatcaatggtagactggataaagaaaatgttgttcatatataccatggaatactacacagccataaaaaaagaatgagagcttgttctttgaagcaacatggatggagctgaagccattattgtaagtgaactaacacaggaacagaaaaccaaatatcacatgttcactctcacttttaagtgtgagctaaacatcatgtacatacagaggggacaacagacaccagggcctactttagggcagggggtaggaggagagtgaggatcaaaaaactacctatcaggtactatgcttgttacctgggtgatgaaattatctgtacaacaaacacccgtgacatgcaatttacctatataacaaacctgcacacttttaggtaccgctgaacctaaaagttttaaaaacagtatatattatatactataatatatatatatatatatatatatatatatatatattccatgctgattaaagaaagcagttttgtcattaaagaatgacatttttgcttatcacttgagaataatgtgcctgtttatgccaatgtagaaaatagactctaatttttcattcaacctatgcattccacaaagataattcctgagggttagaaatgtacatagacacaagaagattacaatcaagagaggaaacaggtttataaaaaataattaaaatacaatgtgatcccttagctagaccttgaaagacatgtagaggggaaattattccaaatgagacagcagttgtgagaaacaatatcaagatattttcactctttctagcctggcataattaattgtgattactctggcaagtatgacatcttctaaatttacaaaaacagctattttgtcattgagggaatcattttttgctgtgctgatattacaataataagctggcttgtgtcattgcagaaaatggtctgtaattaaatcttcctgaacttctaaagagcagtttccacaaaatggctgtatcttctaatttcctttccattttctcagcaagacatagtccctatgacaaaagtaagattttttgaatatatttctcagtttcctggcaaagttgctcatttgcaaagtcacacacccagcccacagaaatttaaaaaaaaacatattttagtcattcatttggcaatgctttttacacaaacaggtaattaggaacactgaaaagacttaaaagatcctcaatctgaagtgataacgctcagagtatgtattggataacggcagtaagacagcagtccccaccaattcttccttctagcttcaatccccatatcttcctcccacctaattccttcccaggttttaaaaagaataaaagactttaaaaaatgaatttgtggcagtatggaatttttatttatttgcttatagcatgtctccattactttaaataccataaaagcagacatctcatctgtcttatttattcctctatacctagcacatggaacaatataaagcatgtattacaaactcaacaaatatttggtgaatgaatgaataagtgaaataaatcaatattaaatgaagtaaatcttctccttggcaatcatacttttcataaatatgaagacattgtcacactgtcattcttatcaaaagtaagggagagggaaatgagcattttgtgattgtttaaacattgcagtcaacacttattgaacatccactacttcttacataaagataaatagagatagtccctcctctcagagtgtagatttagatggggttgcaaatatgcaaacagataagtgtcataatattgatcttcggtaattataaaatttacatcttcagttttaactattcagaagtgatctcagagtagttatatatagtaaatatatttttgcctaagcatgcatgcatttaaatcacccatgctgcaaggcttgagtagagagctagtcagtgattttagattagtgttcaccatctgcacatccacatggcttgtgttctgtctcattcttagataaacattttttgggaaaaatgatttgatgctgtggcatcatgaattcagggatttccaaatatttgtttggagttccaaagaggtgtcttctctatctcttcaggagaattgtcagagtctactatgatatatatgtactaaaatacaggaatgtacaagaaactgggatagcagagaggatgggatgataaactgtggctagtaaagggtgagagaaaggagggcaagaagtcaggagatcgtttgctgagaagttgtatgacacgagtgttgaagattaacagatcgaataggaaattgttaggtaattaaggtaggtaggatggtgcaagaagaagaaatagcatgtataaaatcccagaaatatgaaattatttggggaatttagtaaacaagaaggcatgcggtgttttaagagaaacagttataaaggtgggaggagcatcagatgaaatgggacatttacgaggagccaggccattaggcattatgacttcctttcacagggatctctagatattattagtgggaagttgggagccattgggagattctaatttgggagaaacctgttcagatgaatgtcttagaatgttttagaaagaaccatttggtagctgtgtattggaaatttgaaggggaaattggctggagtcaggtggagaaattagattagtgtgattggccaggtaagaggaggaaaatccctgctaaagtaggaacagtaggaatggagaaaagcagaaaatatggagacatttagaaggcaaaattggcaagatacttcctaagcgattttagtgtacaaagtctagtttctgaatataagttgtttttccttttatttttaagaaacctgtgattttttttccataaatgtgtatatcttttttcactgaattctttttaaatgactggagcaaaggagtccttgaaaaatgtgacctgagtactgtgtttagtagattgaaaattcttcaggggcataagaaattaagaatgtggttttcttccaagatcaagaagctaaggtcatctaatggagaagttcatgtcatccatcacatgttctcatcttgcagatgtggaaaaatgccagtggctggcttctgtttgacagattcagtgagcctgcttcagaggactctgagccaggaaactctcaaggtgggctgcatcccacaggacagctcttgaatttggacagctcttgaatctggtctcatgttgtcaggatgacttggctcaccacaacgtggatgtccttctttgtagcttccttctttcttcagaccttacacaggccctgctatgggaatggctcctgtcctaacagatttgcgttgatatcaaggactccttttttccacactttacctcatacttcaacacttgacttcttgtgcatctcttgcttcctagttttgttctgccattttgttctgaccaacagtcccaacctgttggctctaaaatttcacactcttcacttggcttcaggtcctcggttttaccccgattacgaatcttttaaatattcagttccaaaattattcatccagctctttttgtttcccatgccacatactctttggtaagtccgccacagccagaacatccagaaccacctcaaagctggtatctctcaattcagatttaactcttccattcaaaattatttcacaatctgccaccacctttatctcacccaaagggaacttgttaattttcctttagctcttattccaatccatgacaccaacccactaagccaggtttgggacacccttctttgtaatgctatctcttgtctttaatatccagtcagtcaccaagtcttatcaatttttctcctacatgtgtctctaatcagtctccttctttccattaccattaccacttaaatgtcactaaaaacttttagcctgtagtgtttcctgcccacccgcctaaggtcattctccatcctgtagcccatattaatactctaaaacagaaatacaatctgccaatgtgctacttaatttttgcttgcttacccaatatatatacacttattgatctgtttttctgtggtttttgtttttgttttgttctgagatggagttttgttcttgtcgtccaggctggagtacaatggcccggtctcggctcactgcaccctctgcctcccaggttcaagcgattctcctgcctcagccccccaagtagctgggattacaggtgcccgccaccatgactggctaatttttgtgttttttagtagagacgaggttttaccatgtcggtcaggctggtctcaaactcctgacgtcaggcaatctgcctgcttcagcctcccaaattgctgggattacaggcgtgaaccaccacgcccagcctgatctgctttttatgtgtcaggcactgtgggaggatgcagtgttatcacaataaataaaatatacttagtcaatcttatactcttgatgcctttcagaatctgttaaaagcccttacagttcataaaatcctagtctgttccagcctaccagctgaaaaatggggtattgcaatgggtaagatctacttttcctcgtcctctccctgcccccagagtactgcacagtctgtggatgggtatataaaaggagggaaaaaaaaaaagatctggagtaagaaactagagtccactgctgtcattttagtagtcactggagagtcaagcatttaattaaacatgcaaatgcctgtcactgactacttttaagctcataatttaccatttcaaacatttggctcaaagtactctgaaatattactaacctccatcaatgggaacaaatactttattaatattgtgataaaaagtaattacatattaaaatattaccatatactatacatgatactctaccatggcttcatttttgttttgataataactttacgtgattaaattaacttttaaaaatatatttttaaattgaactatttggtataattctgataattttagaatatgtatactctcctaaatatacaccatgaaaataaatatcacagttagaattttagccaataagaatttatgtcgcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcctccagtgagccgagatcccgccactgcactccagcctgggcgacagagcgagactccgtctcaaaaaaaaaaaaaaaaaaaaaaaaaaaaaaaaaaaaaagaatttatgtcaataagaagatacatagaaatatcataaatatctgagttgttctctaccaaaataaaggatttcttaaataattcagtctgcaatcctaattatttctgcacagtgtaattaaatttctattgtgaaaattaatattcttaaaaagtaataacatcaattgttgcaggcttctttttaataaacatctacataaggtgtctgtatacttggagatatgcttatctgagtaggagaataagatttggtggtaaagctaatctagtaaatgaaatcaaatgagataatagatgcgaagggcttgacacagagtgttgcacactctaagtgctcagtaaaatgccagagatgatgaggatagtgatgctcacatctgtattgtcaggttatctcgttatcctcattttacacatagagatatgaaagctgcgagagtaacaatgactcactcataagggcaggcagataatatattgcataaccaggagtgaaacactgatttttcaaataggcttaaatccaagactcttaaaccatgctttgagcaagaacttctcaggatttgaaaaataaaaagccttgataacccagtgtggttggaataagcactcaagagcaagagagccacagcttcctcctgtgtaaacaggataaaggcacttaagggcaggtgaccagagagagtgagatggggccggagggaaggatagggtgatcagattcagggattggagccaatttttgtggatctagctacgtgacaatatgaaaaatgaacccaggtcaacaaaagttccttactgggttatagtactcttcttccttttaacttgagaagtagaagggtctgacaaattgagtctgatgaataaactcttgtgttggccaattctgcctgccatgtgcccttagactgcttgcagggctgaggcccacagtagctgtcctggccttttgctgtgttactggttcctggtgtacatctctgaaagggctcaggccacccttagataattccacaaggcaggtgccatggcttggatacactcacttgacccaagttagcttgttctgtttattcatatggttgtttttaacttggtagaaaaagtaaactgaacgggaatggaggaataccttaagcaagtttctgtcaaattattatttacttaaattcattttttaagaaactccctttacgaggtgaaacagttgaagaaaacaatacatttcaaatatctaattcaaaaagcatattaatttatgttcaaagatgttttaagaagtggtttaaattcatatttttactttttttttttgagatggagtttcgctcttgttgcccaggctggaagtgcagtagcatgatcttgactcactgcttcctccgcctcctggattcaagtgattctcctgcctcagcctccaaagtagctgggactacaggcatgcgccaccatgcccagctaatttttgtacttttaatagagacagggctttgccatgttggccaggctggtctcgaactcagcctcaggtgatctgtcctccttggcctcccaaagtgatgggattacaggcgtgagccactgagcctggccattttttacttaaatattgagtcactgctgtgtaccaggaaggttctggtgggtgcttggaatattacagtgagaaaaatgttgttatatctttgttttcccagaagtcagtactaagcaaaggagacaggtaatgaaaacaaaacaaaacagtcaaaataaagtgtaggaaatgttaggagagaagaatcgtgaatacagttcataccagggattcctaagttcctgatgaaaggcttcccaaagtaagtgacttctaagctgtggtctgaaaagtgagaaactatccagctagatgaagggttgagaaaaccagaggaaacaacttatacgcagacatggagcagggatgatggctaagctgggcctctgtggtgatgagaatttctcaagagaagtgttggggcacagtcagaggaaacaatcataaaggatcggggagacaaacagcttgctgtgttttaagatatgcagttgactttgtatcataataaaatatatcaaaataactattttaatagtcctataaaattacacatatataaacatataaataatagtgataaattcatttgctattgaagatattgctttggttaaaactacatatttcttattctgaatttcacatgtctgggggaatggggtcaaaacaaaacaaaccagtgctaaccattctggttctatatgcaaagggattccttaaaattgacattgtgtgcaacacacacacacacacacacacacacacacacacagaactggtctttgatgactattttgtataagttcttcatttagcaggtgctctttctgaaaaagaaaatttcctatttttttttcttttgtttgcttgaatgggatcgatgactggctaatcgtaaataaatactaccaagccttttatttcaaacttcagagctttcttctcaaagcccaggttaaaagaagagtcccagttaaatcaagtgacatattctagtccatagatttactggttcatggttctattattcttttattttgtactaagggcactatcaaaataaataaaaacatcacagctgtactgaaacactaaaagaaaaatcttgaattttcagtagtgattttagaccccactaccaagatttttttttctttttgcagccattaactagttttttaaaaatagctaaatttgggaggatctcaacatacaattttagaaagtctagtctgagattactttatcagttattggaataatctgacaagcagaagtaggactaggaataaagcattgattcaagatttcttgtttaaatggtgcttctcattctttgtttgcaaatcttgaggaatacaaagatgaatgagcatccagtccctttggtgtcaaaaatatcatgctgcaagtatttagaagagggaaagaggaacatttgtgcctggcatagcatttcctttcattttcatttattcttctgcttattaattcacttattcagtcaatcaacaaacatttaaagattgcctactcaatacaaaatccactagtgggtgttgatgatgcagcaatgatttggcactgaaaagaaacttaaggtaatggttctcaaaatttgagaaatctgtgaacttctttgaaaaggtgataggtactatgggtgcaacataggcatatctgtgctcataacttcagtggggctgaggaggatgccttgaagcccaccattggattccttgggacttatgaattttgcttagcaatttcttaattacagttttgttcattgtttgaattttgccatccaatccaaagcttttatccttattataaggttgatttcgttttcataattaacccctaaaagtaatattgggtcaaatcttaaagacacttctccagttgagagacctactgctgacgttaaagaaccaacctgctcagtaaaatgaacatgagcgccatctaatgcccaaacagaataaatgttggtaacaacattaatacacagaagattagagtatggggtgtatgtacaaaggaattaactttgttatcggttggttgactcatttctaacacttgttaattattttttgatattatcattttcaattattttatttcacataacagtcccttactgtctgaatttgaagataagaaacatttttaacaataagaaacattttgttggccaggcgcggtggctcactcctgtaatcccagcactttgggaggccgaggcaggcagatcacctgaggccgcgagtttgagagtagcctgggaaacatggcaaaaccccgtctctactaaagatacaaaaattagccgggcatggtggcgcacgcctgtagtcccagctactcggtagattgaggcaggagaattgcttgaacctgggaggtggaggctgcggtgagccaagatggcaccactgcactccagcctgggtgacagagactctgtctcaaaaaaaaaaaaaaatttgcaaatatgtcctttttattggtggagaagcatatgacttacatttttaaataaatttttgattttagaatgtttttcgtttttcagaataatttgcaaagatagtccatagaatacccaagtatcccacacccagtttcacccagaactaatatggtacaattgttacaattaacaaaccagtatcaatacattattattagctaaagtctacaatttattcatattttcttaattttcccctaatgttcttttatgtttcaaggtcccatctaggacaccacattacatttggtaatcatacctccttaggcttagttatgacagtttgatttacatttgatattgtatgtctttgaattttattttagctttctgttatttttcaaaatcttaaaacaatttaacttttcagaaaacactttcccttgttctgttcccttgataacactgcatgactatttaatcagttttataggggtttgtataaacatacattatcattatgcatcgttcatctctaataatgaaaaaaaagggttaagaaagaggattatcaaaatgtttaacttgccaagattgccaatataatataataaataaatgatgggtcagattccaaagcctatgacaccttccaaaaagctaacacatcttttggcatgcataagcttaaaatgccctccaccccagcaccatgctgctgcaagggcttctggaatgaccaacgcccaagacaaagtcgtttgcctttggagtcccattgcccctcacaagcactttttattttatataaaaagtttatataaaatactctataaatgagcctgggttgccacccaaactgttttgtgtttgccacgaaaacagatgtgctgaggtctcaaggaaacttctgtcttacactaactggaatgcattaagtctgaggagggttcacagttctgtcctagttgctaatattttaattaaacatatatttttgtggcctttaaaagccatcaggagatataaaggaatatttttttgataacttcagtgtcctgggagcaaaatggaatattgtgtttcctaattgaagaagtagtatatatgtgtatatggatgtgaaggaatttatagaatgctggcgaaaatgatttcctgggcaaacagtagaggtatataaattacttggatcctgcagtattgattatttgtgaatatatctgtaaaacattaagtgatttttgtacactcatagatttcaaccttggatgcatattagaaaccctagggagggttaaaaatcccaatacccaatcttcattccaaaccagctaaatcttactctccagtaatcaaattcaaaacagcaattttaaagctccccagttgattccagtgtgtagccaagagttctacattgtaactcaggggtttaatattgttcctgtacttttattctgcagcataaacttagctatgctatttattcttatttttaaaagaaggtatggcttacgaaagatgataagcattattatgtttaacaatcaaactcattattaaaattcctttttttcttatacttctgtcaaatgcattgttttttctctgagtaatttagatgaatgaattaataactgataaacacacatgtaatactatgagactcctttcctaaatccttttatctattttcaaaggattttatttctacatatttaaagttttttaaatcattttttaatttgtgcttctatgaaatttttttcttcctagaaattttattccggattatctgttaagagctgcattttgacagaaaatgattttccttattaactgagtgaattgataagtaagtaggaatattttccagtggtagtctcaagatagaaacttctaagagctttgaagttttagcaattaacagactttattaaaaatgaagccactaacaaggatattaatacaaggtagatttcaatctgggcaattatacaatatagacgtctttattactaactaaaatatcacagaatgatttgattaatgctataaatgtgattagtagaataagtgtatccttagtgccattggttagatagccaaagactggatgtcagagaaaggtttccaattcttttctacatatgagaatcaaaatcaaattatagaaaaaagtcacaattgttttcttgaattccttaaatatgtttttcatccttgaattctgctattactcttcattatagtggtcagtttgtgtgtgcttcaagtatgtcactatgttgttaaatatgtcagctgtctacatttctaacacaaaatgatcttttttttcaaccgctaagttatatgctggttatttctaagtacatgcatattcaatctaagtatctcagttgatttaaatcagtttcttactttgaaaagatttttaagactttttttgcacagaggtaaatttcagattcagcttataggccttaataataacactcctacagactgagtcaaatttaaatatcttatcaggtattaaatatatttaaataaaaacatacacattaatgagtgccctgtgagaaagtggtggtgaatttgagccatattgctatatccccacagcaatatctgacattttattcagtgccatcagctatatgattctagacatgccctcctaatcagtggtttgtagggttttatccttcctcatcagaaaatgtaaacaagattacaaacccactttcttccccaactgtaaaatattaattatttaaaattttaccgtgttttattttatacaagtgataatagctcatattatatggtctgaaattaccagtgatgagaataattatttggtcaaatactttctgtaaagttaaatttatctatgaatggtgcttctgtaatgttgacagtaaatacagtaagatattttgcccaaagtgctgtttgtcttagtgtattacttgatgtgacattctgacaccatcagactggaggctgagtcctctgataaaaagaaaaatgccacatagccacagaaattatttcaccctgtttccttgcacatctgggaaataagcaaaaattgtaaaagctgctagagtgagctgattgttttcttcctaagaatcttgagctttcaaaatttgaatttaaaataatggactttcttgtcagaaaaatattgattattaagaaaagaatgagacaaaaatgtaaaaagaaattttacttacctaattttattaaaggagtatttaataaaactttatgatacattttaactaattctggtgaaaggattaaatatttgtttcacccttacctcacaatgtgcacaatgattttaagctcctttctgttaaagcagttaaagacttttccaaagtctaaaatcttaatcacataaatctaaaagcaacacttaaatgcaaacatgagtgaagagcttacgggctttttctactaaaagactttcttctttttctattatagacctatttgaatttggacatttttcttgcacaaataagactgtttcaatacaaatttgaatgtattaacttgctagctcataatgttactcatggtttcagtttgacttgcacattccagaataaatctatttacttaattataaatgggtgtgtgtcattgtccttgacaccatgagaaatataatggctatcaggaagtgggggaaaggaacttagatcttttcgaatgtctactatgggcctgttgtttctctcagttgattctgctaacagcccacctaagaaagtattaatcatgccaagaaggtattatcattattatcttatgaatgaaaacttcacagaggtagctgaatgcctaaaattcacacagctagagtatcttttaagagtccttcttttgcaagtgacaaaataaataagctggcataaacaattaaaggaatccactgactcaaataacagaagcccagaagtaggactagctctctaagaggctagatatagctgcaaaattgatattaccatgaacttggcatctctgttgttctctttggtttcccttcccagcattggccttatcctcaggctctacaagcggatctgctgcagccccagtccccctcactctgacaactatggtgtcaaattggctctagccgttcactagaacgctgtaccgtgttcacaaatgtatcctgcactagctgggggaaaagaggatctctccttatagctctcttataattcctgagatttactcttatcttttttttttttttttttttttttttgagacggagtctggctctgtcgcccaggctggagtgcagtagcgtgatctcggctcactacaagctctgcctcccgggttcatgccattctcctgcctcagcctcctgagtagctgggactacaggtgtcctccaccacgctcagctaatttttttgctaacctcggggaactgtcatacccttgccagtttgggtctgttcctggacctgggggtggcgtcagtcccaccaaacctgcggagctgagaacgggagaaagcgaattgcctaaagaaaatcacaatgctattggctggaaaatttctaccaccgttaagtagtagagccaggattggatataaagtctgcactgtgtccgttatgcaacagaactaacaggacataacttcctccttctgtttacaactggcatctagtggtcagaggccagggacagtaatcatcctataatgcacaatgcaggccacccacgaaaaggcattatccaacccagaatgtcaatagtgccaacactgggaaaccctgtgctatatgatctgctgtggggcatattccctcagccttacaaactgcctccctcccctcttctttaagcagcagctaccttgaggggcctcctttcagttacaaaaatgtgccaaagctcttcaggctttaggatctttgaacattattttcactttacctggatgttctcctcccacccctctgactacagctgcatcattctttccaaacctagccaaaggtggggaagcattgagctcaaagagtattttcttgagaaagactactgattctccagagtgggtcagccccacccacctgtcagtagtgccctgccctcttttatactttaactttgtagcaatgatcataatttcaattagctattgtatcttttacagcaaatgaaaactctaaaacaacaaatgaagacttatttctgtttatactctgagcacttagaacagagtctgtgattaagattggatgtattttagatgaggcaatcaataagagtaaaagctcacaggcttgaatgcagcaagcagtttagggagtgtgctgagtagagcagtcaggaaatatttagtgtagaaaagcatgaacagtaagatggagaagggatggaaggtttctggtgttggatttaataattgtgtaactagtattttctgagtttcaattggaatatgctaactcttctgtgtagatgaagtaggtaaaaccagattaaatctgattttgtttatctgattaagtctgatgggcccagaagaaacagcctgaggcatcacttaaatttgggcattttttataatgcgctgaactcggagccaagtgaactaagatctagagctgagcctaacactaatgtactgttttcattgtgctcttttgagcttcagtctatttgtaaaatgagggagctggactaaaggatctgtgccgccctcctaatccaacactcctcctttactaagctaaaagagagttttggcttgctgagatggaactgtgcaagcattctacttttaaaaattgcaggaggaattttttttaatgcagttgtttgtgaacctggtaataaagaagcagaatattgtgagaataactgaatcttttgataattggggactttaacgtgtcccagagttttgcattattttatacattgaatatataaaagattgggtgatagatagcctaacctcacgatatatccttaagtttttgtgtttttcaataaatccctaggacaaatattttttttccatgaacactctcttaaaataaagtctactatgctttgtcaaagctttgatcagatgaaagcatttatatttctgtttatcctcgtttaccaagattaataggttgctagaggtctgagtacagagtttctcagtcttggcactgttgatatttggggctggaaaattcttttccagggctggggagctgttacaggaatttctaactctaacagatagatgccagtagcacctctccctcccagttgtgagaatcaaaaatgcttccagacattgccaaatgtccactgaggggctcagatgacctcaggtgagaaccattggtttagtgcaaagtaatctcctttaactagagcatactggccagatggatgcaaatattactgcttggttaacccatttaaacaaagttaaatcttgcccaaatgaatgtaaagccctcattgatagttaaatgtatctcactgtttgtcttactgctagatactcttggcacattctgaatgagggaatcagtgacttccttatataggcaacaattcctgggaaatctcaataaattatcagaagaaatgcaaaagaaaacagtctgctgattcagcttgtaagtttccagtggtatcgccttacttcccaaactaaataattctctgagtcctgttccatgataggatagtgactgtgggtcagtgctgtttatgtggttgttgatactcttgtgcctcttttagatagttttctaagagacaagacttttttttttaatgactgttcctctctatgaccctctgccccctcaaggatatcagagtttttgtcttcagcatttttcgggttataataaattataattctaaaaattaggctgaaaagaaagcctcaggtcttttgaaaggaggcagaaatagaactagataagcctttcaaatagttggtatggagtatggagtttgttttttttttttaacagaaagaaaagaaaaaaagagtgtaaaatgtgtcagtgtaatactcacttctgctctcctcctgcttgaaaagatcgctgtagtaattagaatctcaaacggacagtcttagcatctaaagtttgggtgtacttctagcaaacatgcattgcacaagataacaatataaattggccttctgaaagtaaacaaacccaaagaaatatactaatgttgggctgggcgcggtggctcacgcctgtaatcccagcactttgggaggtcgaggagggcagatcacaaggtcaggagatcgagaccatcctggctaacacggtaaaaccctgtctgtactaaaaatacaataaattagctaggcgtggtggcgggcgcctgtagtcccagctactcggaaggctgaggcaggagaatggcgtgaacccgggagacggagcttgcagtgagctgagatcgcgccactgcactccagcctgggcaacaggacgagactccgtctcaaaaaaaaaaaaaaaaaaaaaaaaaaaagaaacatactaatattgcagtgtgctttgctgattttagagaaaggtgctttacacttagtttgtttaagaggaatactgctactcagcatgttttgctttcagtccaaatagagaatccctcatcagaaacaggcttaagtttttcaaatagtttactttttttaaaaagtaggtctcacttctgcttccagccaatatggagtacagtgactagatttgcagtctcatctttaaaaaaactttttaaaatcaggacaaaacatacaaaagaacagttttcatgacagtggacattagacaatggaagatagtgattcctgagagataagaaacaaattaaatgagccctatgattgtcctagctaaatgccttgagaggcatccaggctgtggctcagggaggggcaaaccaggagatacccaacaaacttcttgagttgaagagatggagctgagagtcttgggagaccaaggaggctaaaggtcatagacagagtatcagagaagtaagagttgcaaaaagaccctctgacatcttccaaggatcctcattatgtattctgcagggtagtgattagtgcacatatgtgaagaaactacttgagccctggtgtgagggagatacccaaaagatcatatggaaaagcacctagcacttatacaggacttggaaaacaatgcctgtttccatcaggcagaatggaaaacctcataaatcaaggacactgcagagagtactcaaggttcttgccttagtaagggagggtaattagcccttcatgaaacactgttccagtcttgcctaacaaatcttaaaagcaagacttgaaaggaacaaattttttccaagtcattaaactgcatcccagaacaaagctcaataatatttatgagattataaaaatatccagcacttaagaagtcaaatttatgatatctggcatccaatccaaaattactagacataaagaaaatctgagacatgggactcataatgaagagaaaaattaatccaaatggataggtacagagctgaaacagatcttagaattagcagacaagggcattaaaacggtgatttttaactgtattccatattttcaaaagctaaattgatacctggaagatttttaaaaattccaaattgaacttctatagaggaaaattacaatgtctgagatgaaaaatatgttgaatgtgattaataacaaattagacattgcaaaagaaaatattataaatttgaagacatagcaatagaaattatcccaaataaatggagaaaattattttaaatgaatagatcatcagtggactttggaagtaattcaagctcctaacatatgtgtaattggaatctctgagagggagaggtagacagaaaaaaatattcaaagaaatagaaaattaccaaatttgataaaaactataaacccacagatccaagagctcaacaaacccaaaacacaagaaaaaaacatcaaggtaaatcataactaaattacctaaaactgatgataaaagaaaaacttaaaagcaaccagaagtaaaagatatgttatatatagaagaattaagataaagatgatagcagatttgttatccaaaatgatgcaagatgggagccagtggagcagcatctttaaactactgggggtaaaaaactctttaaacctagaattcaatatgcagtgaaagtatctttcacatatgaagacaaaattaagacttttaaacataaaaaagcagcgggaatttattatcagtgggcctacagtataagaaatatttaagaagtcctgtaggaagaagaaaaatgataccagatacaaatggatctacacaaagaaatgaaggtcactttaaatgataaatttgctatctttccacatcccatgagttggaacatgagggtgctctggatatgtgccaagacatgaagaaggaccaatgaaaaggaccaggtccttgaattactgaggggaatagagcagcctggcaatctggatgacccatctaggaactattattgaaagacaaataaaagtctatgttttcaaagtatctatattttgcagttttactgatactaccaattgtttcttaattaatacaattatttttaaagctgtgaagttatgtctgctacatcaagatctttaatttacttggaatgttttttccacataaaacaaagttgatccagagcattctaataaaaaagacatctttttctcacttatctgaaatgccaactcttttataaatctagcacctacatatgcatggcagcctttctgggttaaatgctccatttgtctatttgtttatatgatgctatccatgcactaattagatatgtttatggtagggcaaatactgtaacttgtcatctttctcagatatatcttgactctttctaccatactgaattttcaaataaattttagagtcaattttttaaaagtaggtgaaaaggttataaggggatgcagctaggtcacattagtttcaacctatctttttatgagttgatatatgcagaagtctccagccccaatacaagggttgttctcagactgacttttttccttacaaccagagtggcaaagagagcctggtggtgaaggggtgatatttggctacttggtaggcatctaggggtcaggtttcctccctccaaggaacactctacattcccctagaactaaggatatcatctcccacttgttatccattcgcttcagttatttggtgtagactgtgtcagtataaccccattactgttatcgtgtttaattatataacaactgtacactgagagctttttcaaggcatggaccagacagactaatcagagagtaaatacacagcacttaatttactcttcagaatttttaatcaatgcctattgactgtctcaagggttgaagtctctattttaactccattttaaaatggagttaaatggggaattcagccaatttattcaacatttatcactaatgttgaatacctgctttgctctaggtactatactaaatgtcgaatattcagcagtaaagaaatatatatactatatacatgtatataatatataactatatattatatatataactatattatatacatgtatataatatataactatatattatatatataactatattatatacatgtatataatatataactatatattatatatataactatattatatacatgtatataatatataactatatattatatatataactatattatatacatgtatataatatataactatatattatatatataactatattatatacatgtatataatatatataactatatattatatatataactatattatatacatgtatataatatatataactatatattatatataactatatattatatacatgtatatattatatataactatatactttatacatgtatataatatatataactattatatataactatatattatatacatgtatataactatattatatataactatatgttatatacatgtatataatatataactatatgttatatataactattctatacgtgtatataatatataactatatattctatacgtgtatataatatataactatatattctatacgtgtatataatatataactatatattctatacgtgtatataatatataactatatattctatacgtgtatataactatatattctatacgtgtatataactatatattctatacgtgtatataactatatattctatacgtgtatataatatataactatatattctatacgtgtatataactatatattctatacgtgtatataatatatacacgtatataatatataactatatattatatataactatatattatatacacgtatataacatatttatataataatataatatattatattattattatatttatagaataatatatattattatatatatataaatatataataatatatattattctataaatatagaatatatattattatatatacttatatataatatatacatagtataatatataatttatataatatataatatatataatttatatatattatataaaatatataaatttatatatatttatataatatatataaatatatataaatataaaaatataaatatatataaatttatatatataaatatatttatatatattatatacaatatagtatacaattattaataactatatataatatacatgtatattatatatagttatatataatatatagttatatatattatatacatgtatataatatatataactatatccttctctgatgggaaaatccaacatttaaacaaaataaacagaaatataaatatttaatttataattatgtttagtgctatgaaaggaacaaataaggttttatttaagaataactggagggagaaagtggagaaaaatatacttttcaagttagaccatattacatacagatgaaatctgatttaacctgtaacataaccagatttatgtagcaaattaaacataaattttttcatatacttaatctatttatttgtgtattcaatagcatttatcttctttgagccctataatgatccagctattaggctcacaaaaatgaccaggactcagttcctgtctttgaggagctcatagtttttttttattattattattattaattagcagtgcctttcattaaaataattgcataccaaatggaaacaaatatgttccttttcctctttcattcttctttagatgaggataggaattcactcaggctccgtgctggctggagttgttggggtgcgaatgccacgttattgcctgtttggaaataatgtcacactggcaagcaaattcgagtcgggaagtcaccctcggcgcatcaatgtcagcccaaccacttaccagtaagtgttctctggcctcctccttcctgtcttggcctttgttttgggctgctatgctgtcatctgtgagtccctgttctttttcttgatcctgtcattctccaagatattatgagtagaactgcccaaacccaaaagatagatagtaattgtgacacaaacttttatttgcactctgtgagagtgcatgaaaaatctgacatgactgagaggtgaatataggtttgtcatttcccacagtctctgtccttcttaagtatacctgtttaaaatacaggagagcaaatgttcttaaggatctgcattataatagaaatctcaatattttcaaaatgtttctgtttataaaaatggaagaaatacaatagaaaaggtggttggactgtttttttgaataaataaataaagtctttaaatttatatatatataaattataccttactcaaaatgcttgggaccacaagtgttttacggtttgaaattttttgagttttggaatatttgtgcatattacctggtgagcatcccaaatttgaaaatctgaaatccaatatcttccaaagagcatttcctttcagtatcgtgttggttctcaaaaagtttcagattttggagcattttggactttgggattttgaatgctctgctataccaggtacagagtaaaacattaaattctttttatcttaaaggtaatctttgacaacactacacatttttgcctcctgaattcattcttattttgtgtctggtagaaatttcccctattagatattaagccctgtatatgggcagcgactgtgtctctcacagtcataatgatgagtttggctcatcattatatccccaaacttataaaaatgtctagcccataataagcactctgtaaatatttatcaaattaatgaataaatacattgataagatggacattttcaaaattaacagcaaagaaaagcatgaaaatgtcttactttatcacactttggctttattctgggcattactgtacagctgcttaattaatttcatgttttaggtaacttagaatcatactgaaaaaaatgtatagtaggaatagtggccattgatttttctattaacatggttacaaaaaactcaagcagaaaatttgaatataaagataaaagttgactataataataaataaaatagtgatattttcaaacttttgataccaaattagagggtaatttggtatcagaaattccagagagggaatttaaagtttttagatgaaagcagatacttccagattctgcaaaatagatgagaaagaaaactgaaattacaaatataaaattaagagaaagtgcacattaaaaatacattttaaagctcttgctaagctcattaaagtagtggataccttgattttacagtttttgaataaagacacacctcttactaattttaaggaacccaagagattttgagggcctcacagacaacttctggacaaagtttcaggattctatctaatcattacttatctaagaactatatgctattttcaggatatttataagaggatttgcatcttttaaacttctcccaattttcccaacacaattctgggcatattacagatgatctgacaacaattaccatggcaaattgaattttgtcaaattctctagtagagatcagtgattctgatactttctgctctatacgatgaaaaaagttactgaagatcagctacctcactcatatcctattacatggttccatttattcccatcatggtattgatacttattttccatgtttgtgtaacttagtgtagatttatgtcttctgtgacaacttcacttaaaaaaaaaaaaaaaagatgtgtaaaagaatgggcccaacctgtgtgaggagttcatgccctgttgcttagacatcataacagtagctggctttgtttacatagtgatgtattaaaaaaaaaaaaaactctgccagccatacaagtctgtgcattttggtggtgactcagagtttttgtagtctttttcacagtttatgatgatccttagtgattaacaaggtctgaggaatgaaatcatttcaactactgcatacactgaagcttactgttgtgttattgttctgcaccttcacccccaggccccccaaaatcaaacagagccatagatagacacgttgagctgacaggtgggtagattcttagaacaaatataatttatgaagtaaaacccagtattaagctcatgagagtttgaaatctctattttatccctgaattacattctgtagaatgtccaacattacctgtttatcttgaaaactatatgattattataaactttggaagtggactgttttgatattatgataaactgaaatcattttttgaattgttcattccaaatgcattttgtcttaaatattcaaataattgaattttaaaaatatttttgtaactattgtggagtactgaaaagataataaaatatccatgatcctaccatagttaaacactttatattttgcttcagatatttcttaataaaaatgaacaaaacattttctttgtaattttctcagtctttcattgtgacatcctaatgagtttggtgtgtttcaaaggcccgtgttttgtttttccttcttttttttgagacgagtcttactctgtcgcccaggatggagtgcagtggcacaatctccgctcactgcaacctccgcctcccgggttcaagggattctcctgccttagcctcccaagtagctgggactacaggtgcgtgccaccacacctggctaattttttgtatttttagtagagacggggtttcatctttttagccaggatggtctccatctcctgacctcgtgatctgccctcctcggcctcccaaagtgctgggattataagcctgagccactgcgccctgcctcagtcccatgttctatatattaactttctacatatgtatccatgaacaatataattttattttacatgttttaattttcataaatggtattttactgtatgactgttatcactaactttggtttcttttaaacacaatttaatacttttaagatctatccatgttggagcatctttctttggaaattccaaagaaagaatgggtttggtaatttggtcgaaggtgcattttgagctgtaactaaaagctgagatagtaatcagtttattcctatgtgtttttattaacaaaagtcccttactgatgactgtctaaatcatagacagctctagctcatcattttaatcgctgtatgacatttcagtgtatgactccaccatattttaatatttcatacatatattcctctgttgatcaacacttcggtatattttctattttttaattatcacaaagtttgttcctgtgaacattatttacatgacattacaaaaaagaaatttttattgagttttaagttttccaaattagacattttcatttttcttcaataaatgtgtttacacacatttttgttcccatcatcccaatgatgggataagttttttatgggatatggattttaaatagtgcacataatatatgcaccattaatatatgcactttaaatagtgcatataatatatatatcatatatactaatattactttactgcatataatatatattttaaaataatgcatatattataaacaactgtcttaacatcatgctgctgatctataaaacagaaataattgcttatatgaaggatggctttagcaaattttgaaataaatgatttatctcagcataattattttttcttgctacagtgcaaactaaaagtgtagaaagacttgaattactttggtatgaaatttttcttaatctttaaacatttttgcttttctcattttacaattgatctacttccagatgttttagaacgcctatttttaattgactgtgaaaggcttctttctgttaaaaccaagcttcttcctaaccactgctacctgaacagctcattgtatgagagcatgtacagtcgagcagattaggcagtggtgaagtgcatgagctcagaatcaaaatgcctaaggtagaatccaggctctaaattttcctgtctacatgaactttagtgacttaatttctttggaccaagttatctcatctctaaaatgggtacatgtttatgaagattattgttggcatttaatgtgatatttttaaagctccttatacttggaacatattagacattcatttactgcttcatcctgttctttccatggaggaagaaaccatcttattccttcacttgaatctcataatttataaatttagccatgatgaatgatgtgtgctagtaggattacagacctcatctggaaatttgagagaaagaatgggtttggtaatttggtcaaaggtgcattttgagctgtgactaagagctgagatagtaatcagtttattcctatgtgtttttattaacaaaagtcccttactgatgactgtctaaatcatagtcatatgattaaaaattggctgtgtacatgggaaattcccaaatttaagctaaggtacataattaattcaattaatcacatgattaattgaattatgtacctctgcttaaatgtgggaatcatatatgtatatctatatacatatgattactaagtaatcattacttaataagtaatcatatatatgtatgtaatcgtatatatagtatataattaatctaattagtaagtaatcatatatatgtgattgcttactaattagattaattacttactgttggcttcaacaacacaaacattattttatagttctatagggcacaagtctgacacaggtctcacctagctaaaatcagcgtgggcgtcatgaggccttcattctttgctgaaagttctaggtgataacatgctttcttgccttttccagctttgaggccactctcattcctctgttcagaaccttcttcttccatcatcaaagccaataatagttcatctttctaattctacttctatcatcacatatcttttactgactcttcctccctcttctacttttaaggactcttttgtgattatgtcaggcccactggataatccatggtaatttctctattttaatgtcatctgattagcaatcttaattccatctgcacccttaattcatcattgccatgtgtattagtcaaggttctctagagggacagaactaataggatagatgtatgtataaaggggagtttattaaggagtattgactcacaggatcacaaggtaaagtcccacaatagggcgtctgcaagctgagcagcaaggagacagtccaagtcccaaagctgaaggacttggagtccaatgttcaagggcaggaagcattcagcatgagagaaatacgtaggccagaagactaaaccagtctaatctttccatgttcttctgcctggttttattatggctgtgctggaatagattagattgtgtccacccagcttgagggtgggtccgcccttcccagtccactgactcaaatgttaatctcctttggcaacactctcaaagatacacccaagaacaatactttgcatccttcaattcaatcaagttgacactcaatattaaacgtcataccatgagacctaacatattcacatttttcagggattgggatgtggacatcttgggaggtgggggttattcttcctacaagaagggaaaatttaaatgctaaaacctgcctggaaatatagccccaatcttacttctgcatacttgtctttgaggatttgaaaaaaaaaaaccatataaattatgtaagcaaaatctagggaggaaaaagaactttcacaaatgagacctctggcctgtaaaggatttttactgggacttaagatatagattcctgaagacaggaatctagtgtaggactgaatgatatttctatatttaagaagcagtagagcccttggcttgagaagactaagaagctatcctgagaaataagcagtttttataaagatgactgcagtcctctcactgcataacctgccctcagacacagatacccacatatcatctcttacaaaactcaagaagttataatatttaatttctctttagacctctagcaccaagtttaaaattgcacagaccacatttttgtgcaagagtttgatacagtgcataattcctaccctaggaattaagagaactgcatctaatattggttaagctatttgatgtcctagatgagctctcatgcatcttttagctccaatatctcatcatagtcacagcaaacatttattgaattactgacaatttatttatattgtcatttaatccttacagcaagagtgtgagttctgaattgtgattatctttgtttttcagatgagaaaaactgaaacttaggttaaataagtcactaagaacattgagctaaataagtgcgggagtcataattcaaacccgtagctgccctactctaaagcctgagatcttatctgtggccaagctgtcccatgggttgataactacttgaaataacatggaaaaaaacaataattactttttaaattttttagctgacacattatagtacatgtttataggatacagagtaatattttgataagtgtttacaatgcataatgattaaattaggataattagcataactatcacctcaaacatttatcatttctttgtgtgaggaacattcaaactctgctcttctagctttctgaaaatacacaataaattatcattaaccctattcaccccaagtgctacagaacaccagaatttattcctcctatctagctgaaattttgtatctgttaacttctctacattgtctcctcccccttacccttcctagcctttaatacccacaattctactctctacttttatgagcacaaattttatttttttaaagacccattaatttctgaatattactagcctcgatgagaggatttcttctgcaagaaaatggtgaagagagcagtggggagcaaagtggaattacagcaagggagattcgttttctctttgtagatataatgccctcaggttgaacttttgctattctggagttgtttttatactcaggataataaaaaggaaggatattatttctaacgtgtttatttggagtgtctgtatttctaactatattagtatctctgtctctagctctgaaatgaacatgagtatatgggacaaacttgtggcaagtggaagcttccaagtgaaaaaaaaaattgtctgttgcctctgtgaggctaaaaaacattttgtataagcatgtctctaatgcatataataatttactgggaatataggcttgcttttaggaatttactttataaacaatttggaggaatgcatatctttctggtaaattcagagaaagacgaatggaataattgaagaatgatgacattccttgggtatagtttttatttcattaaactataccttcgatatagtttaataatcagtaatactagtcaaaaacactagctagaaactctgcttctgttcctttgtcaatataattattatacaaggatgagatactatgttataaatatttactcttcttcctatggacgcttaatgtggggaaagatccaaagaaacttcaagaaattcttatctagtagtttttctgtagccttttcttaaaaaaaaaaatcaacatgctcatctgcactagtgatttgatatttaaaaataaaaagtattcgggctggcatgctactatccttcagtcttttaaataactttattaatcatcttatccttttctctatggaagcaccaaaacagtaaacatattttacaaaagaaatataatcagtaaagacaaatgacttagtagttttcccaaaaggataaactggagcggtgcctcaagaattacatttctatttttccaattacaaacagcaacattaatattacccttttaaatgtgccaataaaagtcatatctagcacaattgaatgagatattctactcatttcaatacttctttttactatctctttctttgtctctctgctatatatcaaaaagcattttccccagaaaatgtaattctgtggatcaggaatctgatgccttcccaattttttaaaaataagtctgtcttttttgggggtagggggattttagaatattccacttcagtcattccatatatttaccagcatatttaaggccattgcagtgaagtctttaaaaatcagaatataatgttgcagttatttttacagtaaaaatagtaaaaacttacctattagcttactcttaaaggtctaattgctaaaatttgtaagaatcaatgagaaaatatataattatgtactttgcaaaagtggttggttgttttcatagatatgaaatgaagagtatgtctggaaatttaagacatatttttccctgggaggccgaggcgggcggatcacgaagtcaggagatcgagaccatcctggctaacatggtgaaaccccgtctctactaaaaatacaaaagaaattagccaggcgaggggacgggcgcctgtagtcccagctactcgtgaggctgaggcaggagaatggcgtgaacctgggaggcggagcttgcagtgagccgagatggcgccactgcactccagcctgggcgacagaccgagactccgcctcaaaaaaaaaagaaaaaaaagaaaaaagacatatttttctttatgatttagtttattatttggcataggtttggcttatatgattaggcataagattaaatctagaagtaaagttttgctgtttttctttaggtcccattcctaactagtatgaagggaaagcttggtggttctctcttctcatgacggcagggctaaaaagttaattacctagttccaggattcagaatttaaaggcattaatctggtattcatgtcgataattcctatttatatgggagacatctgttaatttcacacacagaaagaatttccttgaagtataaatactgtgattggcaactctgcttaaatgtgggaatcatatacataaatatatgtcataaataacgtttacaaagaatgccaagcttaagtaaattttccacattatctaaaatactataaggtgaaaattagttactaaggtaattaagcatgatttaaagcaaaagaaaaagtcactccttacattttcctttccctttctccattaaaaatggcaccatttctagtggcctggaggtcaatatttattttgtaattaacacagctttaataatcctttctgaaggttcttttagatgtccacagtttagctaaaaaggccaagttctttagaaaagtaagtgttaaacatgtttggctgtggaaacaattcaagtaatatctaactcaaaatccaaggtagaacatagataaaagtattactgttgaggattttgggggctgctgttacatttaagccttatgattagtgtgtttatgaagcattttctttgcatactcacatgtgcttgtttctggaaagagttttttttaatattctcatcagatttcaaaatggaccgtgattcagaaaatattaagaatcactactgactgattaaataaatgaatgaccaaataaaataatgtgaatttcatattcctgttctgccactaattagtttatggccctggataagccacataaatgatctcatctttcatgtacttataaactaggttaggtctagataattctacaaatattttgtactaaatcctggaacagaaaaagtagcattaatagaaaatcagtgaaatctgaataaagtctgtaatttacttaatagtaatataccattgttaatttcttagttttgacaaatgtacccaggttaagtggaatgttaatattagatgaaattgagtaaagaatataagagaactcacttcttgcagaactatactatatatctttgcaattcttctatattatctttgcaattcttctataaatctaacattattccaaaaaatgcttatttaaaaaattattatagttctgacatccagaccaggcacagtggctcatgcctgcaatcctagcattttgggagtctgggggagaggatcacttgagttcaggagtttgagaccagtctgggcaacacagtgagaccttgtctctactaaaattaaaaaaaaaaaatccccagacatggtgcatgtgcctaaagtctcagttgctcaagaggctgaggcagggggatcacttaagcctaggagatggaggctgctataagccgtgatcacaccactgcactccagcttcagcaacagagtgagaccctgtctaaaaaaaaaaaaaaaaaaattctaacattcagtgaaagctgtaaatttattttcaacttacataacagaggatcttatatattattagagacccactgaatgtttttgagcctggaaacaacatgatcaaagaaaagcttacttggaagtgatgttccacagggagtggagtagggaacacctagaggtgaaatgaccataagagaagaggtcattgttgttccaagcctaaggtacagtcatgaactaaggccatgatcatgggaatagaggtatagaaggtatgaaaaaactttaaagaaataattgacagggctgactgggcaaaaacacatagccattctatatattgtatggttaatactgtgccttgaaattggaaagccatatttattcactctcagaattaatgccttatgaatatatttttaactttaaagttcttacttttaggtttagcatgtaatcaagcctctatatcgttttaaatttctccttttttctaattgtgtgtacattgtcctttgaaggaaatggcaaaattttatattatattgtttgttcgtatatggtactatgttgtattaaggaaatatgtttgtttcaaatcctctcaaaacaggaaggtagacttttggaagtctaacttccaaaaagctgatcatgaattgtattatttaaatacattttaatatttaataaaatacagcatgtttggagtattcgtttttaaactagagaattgaaaccagtcttaactgggccttaatcttttagcagtcagttcttcccactgctcttttgtgtgaaacactgtgcatcaggaaaaatctgattgctctaaatgctatgttaagaatcctttctgcagctcttattaaagtgcaaagattctcatgcattagtcacctattactaaatcaaaattgctttgtaatcagtttttgtgatattagccaacatgacagtgtttcctctggagatcttacttgaaaatttttcagatttgcaagtctaaaactaacatgtttgatcacgctgctttgtatgatcctctataaactgaatactttataaattctcaagcttccctaaatgttagagctgtaactaatctttgaaataaattagagtaaaatctttctttttccacaaggaaattaagaaaccagagaatttaagcgacttaactaatgccatcaactaatttgtctctatctaacctgtatgggggaaagaaaaactctaaaatgtaagagattagatatactgagcctacctatacctcttctcctctcttagtttctctccacaaaaatgagtatttctgagaagcataattttagtggaatttgcaaggaatattttctataaaacattgttcatataagaagtcggttgaactcttaaagaaaaggaaaaaagtatgccctttttttagcctccaaatattttcctaggttgatttgccttcttgggggctgaagttattaaaatttgcatgatctccttagaatacatttaggctaactatttctgattggttgaataatatagaaaatagagaacatagaattcttaagtctaggaatctaatttggtactaatttttaagtaatgaaatcaactaatattaatttttaaaaataattgtgcatattttcttctttccacttctttatcttttatacagaaagaccagcacaatgatgaacttgtttttaagaaagacttttggtcagagaagtgaaaaatgtgaggaaattatttaacttacaagaactggttacagttatcttttctaatctctcacttatctctttttaaagttctgtctatagacatatcaaacttttgcatgaatgttttaaagtttaaattccttgacatttactagaagtggagtttttaggctgttaaaggtcaaaattgacagggtccagagaagtcaatggggtagaatgatctttagttatttagcatcctaaaattcaagaatgtaaagggcattagttttgccactcaaataggaacatcccagaagatgtacactctctagcaggtatcaggtatgcagagtatgaacctatacttaagcacactttgccatcagtacctactcctggggtgggttgcagaaaaaatgtgcaggggtgtcgctgaagtgcctctgagactctctgccttatcattttcaggggacatacaggaaggctatccctttaggagaacttattggcctgaattttagatcccacagattgcctcaaattataaaattacctcaacatctacaagtaaaaatatttgcaaccttaaaacgcataaacatttggtgagatcctttttctgttttatttcatcatgagctagattcttcctttccttatttggaaaggtgtatttccagagaatgaatcactgcatttcaggggatttcaggctgtctagccgactcaataacaacagttccattggacctatcttcagactgcatcagatcttggagcagtgaagcacaaagcagaaatacagggcagagttccttcctttcttccactcaagtagaaagaagaaggtaaataggaaaaattcaggaactttacaacacttaggaaaacataatgtgtcttgatgtcttttattttcatctttcagaaccgtcgtccttctcctacacccaaaaatgcagtgcccaatgctattacaatagaatccaaatgcattccttagcaaaaaaagatattcagatgaataatttgtaacaacagaaatttctaattaagcaaattgaggccctgagtttatcattacccttttcggaagttaataattaatcttttttgaaacgacaacaaaatggcttccagatatcactcaggtacacacttgccaccgtcctctcttccattttgttggaacaaaatgacatatacacatacaaacacacaaagactggaagaggatttaaaaatggaagagaggaaggtggtaagtgtatgcctgagtgatatttggcttaatgtctaaaagaaagctgaagtctcaggtcctacagaagagggagtgggtaagaagcaagtatattcactctaaatctaaatatcagcctgtttacatgcacacatgcatgcacacacacccaacctaattaggaggataatctaaaacatccaaaatatgaccaaaagagattccagaaaaagtacaagggtagaaaatactctagggtattttaagtcagaagatatacagggaataatgtgcttacagaatcatgagaagagataaaaatcaggttctaagctggatatcttgaaatgatacccataaaatatagaactggccaggtgcacaagctcctacccctgtgctcaccacgggaactgtaatagtctaggtcaggagccgtggccacagccataccagcctttggacgtcaggaaactgaaaaatggatgcctaaatatgcattcccatgattatgaagttagatgttagactaacgtgtcaccagtactgggccattttcttgacacttaggaagctaaaaactggagcctgcttctgcaaaactccaatatcaatagtcactgttaatggtcagttgccaagggaaacggaatctacttcacttctgccattcaaaactttgtcaggtcaatcttattttaggagcctaataattactcagaaccatagtagctagggaaattgggaaatgtagtttcaagctgggtagccatgtacttttgtagaactttattactaataaataaagggagaacaaattttgggtcacagctaactctagaaagatatgagaggtttgttctcctgagacattgaaccagaggaattctaaattcaggaaggtaaatatgggaggattaaataaaagtctacattcataacagtgagattcccaggttatttcctaaattcaacttccagaatgctggaatccaggtgtaatcccataggaatgattggaatattgttacttggacaaactggaccaaaggaaaaacagtaaatatattgatatttgggaaccctaatgaaatggtcagggtaaacctacaattcaacattattttgctacacacaaaacttctaaccatgtcataatgacttatacttaaatagaaagatatttacagacattagtaatttgttgaatgccttgacatgaaaaaagagaccaaaacaaaaaagcaaacaacaaaatctagtcaattaatatctagaggaaaaagagacaatatagagaactaaagaaaactataaaaagatgattaatattctcatagatttaaaatagtaagaacacaacataagaaaaaataatcataccacaagagtggaaattaaaatgagatatctgaaattttaaaattctttatgtgttgggaaataatgttggatgcaatcttccagaaaatagaatgttttaaaatgagggaataattcgagaaaaaggaaaacaaattagaagattaatttaccaggtcaatgtctgactaagccaaaatgcataaaaagaaaacatataaaacaaggcatacaaaattattaaataactttttaaaaattcctagaactgaaagacatagtttgctacgtcaaaaggttcaaaaggatccactaattgtcattgtaccaaataaaaaagatgcacttagccatattattattaattttcacaataccagagatagaaagacgacgatgatgatgatgatgatgataaaaaagactaggagaaaattcacatgcccaggattaaaaaacagaatgacatcttactttttaacagccaaatactgaggagaaagtcaattctaaagaagaatttaatacctaattaaaccaatcaagttgagagaagaatgaactaaagatatttccgacatctaaagtctttaaaatgtcactgtcctcatatcttttctacccctctacaagatgcatcagattctactgcctcttcctttgcccttcaagtatcgcttggtgagcagtagctgggtagtgagtagacaaatttgtgattaccccctggtagacagcattctgagaatgtcactctcttatagctctgcacattacacagatctttccagttgttgaaacaaacaaaagattttccaatttcacacagtgatttcaaacgtgcagatgtcagagagctatatatactagtctgccgctattagaggctggaactggatctattcatttcagcaaggtttattctgtccatggggttgtccagggggcaaattcgcaaataaaaataatcactttatggaaagacattttcagcaaaactcaaaattctcttgtttccctctcagtcttctcctgtcccatacatattatcgtcagagataggaaagtatcggttcaggcctagctcacagaaggcacttaatgattacctgttgaccagttgactgctgaactcactgacccttttttaaaattctgtgttttgtgttaaaatttgaactacatttagatcatttgtacttcagtatgaataagtgtcagaccctttcccaaggtaggatgtaggacagagcacagagcttggtgaaaattggaggaaatgagcataaaaacaagaggtgagagagtcagaaaccagcttcatttctgcagctgtgatggagaagctccatggacctccatggaatcaagcttcctgcacatgcttgggagccatccattgatccaaagcagcagtggatttttattttgaaaaacaatttgtagaaaaaactgttgagcagagaaagggtgacaggcaggtaaactaggatttgtgtgatttccaaatgcttattaaacatgttgccaaaactcccagagtgtgtaacaaccagctggggattacagctggggattaatttagaggattaatttagatttatatagaatctaaccttccatatcagccctgaggtgctaaagaaatggattgttaggcagagctttagagccaacccagggacttggacttaataaagcatttcagaggggatcctaggctctgggatgatcaggttctaaataattcctaatccttgtatacatttgattgcttactcagtttcagcaccatgactcatatcatcaacaggcatgctgtgtgaaatgattcccctgacctcctccacaaaccccccagtaagtcattcagattgtcctattggaagtcaactgaatattgcacttcagtgttcttatctacaaagtctgctgtaataaatactggatatcataggagcttgaatcaatttatccttatgtgctctcatttttactattgaaatttaaaactgtatttagtttatggataccaaaatgtttactgggaaaagcaaataccatttcataaaaactgttgtctctgtaatttctagcaaagtacatgagatctatttaaaatgtcaagagatcaattcattgtgaaaagtttcctcccagccaatgtgcagtgaattatttaaaagttctgacatctgaagcagctggtaccatcttctttcagtcatttacaagtaccttcatagatctaaccccatttttgttttgggttgaaaaatctcaattatagcaaaacaaagatcttggtgagacaaactgtaaacgatacatttgaggacttaaaagatagggagaagagagtgtagctcatgtgcagtcctaattgttgattatgggctttaaggaaactttgtggaaagactgaactatggctatatgtggttcttaacttttgtacttaaatccatagtcatcatctctccctttctcctgtagaatttcttcctttagattgtatcagatgttgtatcattgtattgctaatttgtttcaatgagcatttcttgtctttttagttatattaacttattctgcaagtccccacttactcgtctccattcagaggactatttacaatgtcataaccactaaaaaaaagtttgattgattgacatcaatgattgacacctatatattacacattgatgactgttctatttgagcttagcaaaattgttgtggaattcactgctaaattaaaactgctgtatagagctttttacattttatttctgaagtgactgattatatattaatagtaaagaaaattgacatttgtgaaaatgaaagtaaaaagtactgatgacttccattcttattgtcattaattatttcttagtttagttgttttgtgatggagagctatcttacgtagtcttgttatttattgttgggctaagcttgactgtgtttacaggtctaggttccagttccattgtcactactgtcttgctgtttcctggagcaattcagtctaacttattctgaactcattttcaccctctataaatttggtggagatgagcatttttcagcttttaagttcaggggtacaagcacaggtttgttacatacaaatgtatatacatacttacatacatttgtaaatgagtgtcatgggggttcgttgtacagattattttatcaccaaggtattaagactactgcccattagttattttcctgaacctctccctcctcccatccttcaccctccaccctccaaaaggctccaatgtgtgttgttctcctctatgtgtccatgtggtctcatcatttagttcccaattataaatgagaacatacagtatttggttttctgttcctgcattagtttgctaatgataatggcctccagctccatccatgttgctggaaatgacatgatctcattctttttttatggctgcatagtattccatagtccgtatttaccacattttctttatccagtctaccactgatggacatttaggttgattccatgtctttgctattgtgaatagtgctgcaattaacatacacatgcatgtgtctttataatggaatgatttatattcctctgggtatattcccagtaatgggattgctggatcaaatggtatttctgtctttaggtctttgaggaatctccacactgtcttccaccatggctgaactaatttacattcccaacaactgtgtatacatgttcctttttctccaaaaccttgccagcatctgttatttttttactttttttttttttttgagactgagtctcgctctgtcacccaggctgtagagcagtagtatgatgtcagctcactgcaacctccacctcccggttcaagtgattctcctgcctcagcctcctaagtagctgggattacaggggcgcaccaacatgcccggctaattttttttgtatttttaataaagatggggtttcaccatgttggccaggctggtatcgaactcctgacctcgtgatctgcccaccttgtgagcctcccaaagtgctgggattacaggcgtgagccaccgtgcccggcccttggctttttaataatagccattctgactggtgttaaatggtatcttattgtggttttgatttgcatttctctaatgatcagtgatgttgagctttttttcatatacgtgttggcttcatgtgtgtcttattttcagaaatgcctgttcatgtcctctgctcactttttaatggggttgtgtttttttcctgtaaatttatgtttcttatagatgctagatattagacctttgttggatgcatagtttatacttttagcttttgcatacaactatattatgtgaataaaatgggataaggcttttgaaagaattttgaaatgttagaaggagacttgttttttatataccgaatgaatatcatcattttgtggttttttttaactgccattatatcctttagcaatcaaaatactatagctctagtttttaaaattaaatatagactgttcatattataacttattagtactaccaactattgttttaggtaatattttctatccattaatagcattcgaggaggaatattttcttcttctccttagagatactcataattgattgtgcaatgttcttatctgttcacacatcctttattcttcttgtgctcattgtttcttttgccccgacctgcctcctacttggagctgctgctaacatgaatctgtcttaggaggatggattgtttttaagaaaaagataatgggtttggatccaaggtgctttccaaataaagtctaaactcttagtttagggctttaaaactttttcctaacctactgccccagccttaaccctcattcttacctcactgggtaatgctatcatatggttagaaactttacaatattcttgtttctaaccctttggttacattgttttccttatccacttgttgaaactgtatatgcctttaaataacatctagtccatgaaagctttgtggtcctcccactgcaaatactttttttcttctagacttctgcaattttcgtgtctacttttctgatggcatctagcctattacgttctatactttgatattactctgtgttttgttcatttattgggtttttttaaaaattcttttattctgtttctatatctgttgacaaaactgtgagctttttagatgtgttccacttcttatattcacagaagtgtctaggaggcttttcttgggcaataagaaacagtctatcaagagctgttgaattaaattgaattgttgggccacacttttagatacaagtatcaaactgaacctttcatgaaactggacaagtttaaagaataaatttattccaatgttgttagtgttttgaaaaagagtctttatgtgtgactggaagagaagaatcaagctgtttaaccaataatgctatcgagtttggatagcatgcttggctagaaatcagcaagcagatatcagagacattgggagtcacgaagtgttgttctacaaagttaaatacttgattaaagttttttacatacaggacacacatttaaagcttacggtttaccaaacataaaaggagtgcactagaatttgggcaggttttaaaaacggaaaaggtaaatcctgcatgcttgaaataaaacctgtattatgaagtttccttgggcatttgtttagggaaaacaataacatttgaacaaatattttcaaggaatgctgtttagaaagaaatcaatcttgaacaaatattttcaggtagtaccatactcagctttggggtttttttattattatcacatgaagggatcttttctgagttataacatttcctagcatttggaatctgatgaaggccacatctatacaaagaaatagaggtattaccatgaacagtcagagataggcttcctgagcctttaaaatttctgtccatgtatttacatttccctggcctacttgattcatgtgctctgtattttcttcttagattattaaaacgagaagaaagtttcacattcattccgcggtctcgtgaagagcttccagacaactttccaaaggaaattcctgggatctgctatttcctggaggtaaggactggtccaaagccaccaaagccttctctttcttcgtcgagaataaaaaaggtttcctacaacatcggcaccatgttcctccgggagacaagcctctgagacctgctacagatcaaagactcctccaaaaagcacaagcccagaacatgggtcaccaatggggggtggaaagagattgtgtctctttcattgctttgttgagaacaagcagcaaaatttctgtattatgtcaggcaataatcctactaaaaggtggaggtgaccgctgtcaataaaaagccggaggatgagggaaataagatgtgtccattcatatgagtggttttggtcatatatatacacatatattttaattacaagtgtgggtcccctttcagaactaaccaataaatagattccatgttttcttgtttatcacacatacaagtatctttccctatatatttgtaccacttttgagagccagttttgattatatattcctacatttagtgagttggtgggtgaggaatattttctaagtttctttttctgaacagacatttcatacatgtatcatggcagtgtggtaaacttcccaactggaagaattgtaactcggcaaaatattttagggatattacctatttttatacatatctcttctagataactacatttcgcacaacattattagattttcagaatctgcttctgtattgttagtatattatatataatgctaacctattaatctaatatagtttcccttatttagagagatcagtgcttcgactgagaatacatataaccaaggatttcagataccaagaaagcattatatgtctgcttagtaaatatatcttttagatttaactaatgtagcatggaatccagaggaaatggaatttcctaacaccagatgtatctgtaaccaagattaaagaaaggtctttttgccaccttctaacaaatatcagttaaaatgaaatgctttgctacactggatccttttcaacttagcacttacaaatataggtagcttttgcaacactaaactgcattctaataaacagcattcagctaaatgacatgttagttacccccttcctcttccccagttgatgcctcctaagagccgactgctattcttgagaacaaattcctggatactggcattagtgacaaagaagtgtcaggacagtttgccaagaatgttgtttcttcttgtacaacacaaagcaaggaaacctctgtattttatggctttgaggttttaaaaaatgttctgcagtttgattgatatggcttttaaattcagtgaatcactttcatgaatactgaagtaggtataatcttcagaactagtaatcattatagttacagataggattccatcgcatgtcctgctcaaatgaagacctgttctcattaatcaatactgcatgaaaatattactggctcacactaaaattaggagcatcaggtgtccagagttttcctgtttgggttcagatataaaatctaagtttctattgaggttaataagctggaagcatttgtttcctttaagccttggagaggtcattttcttactcattgatagcttatgtctactgaatgcaatattcttttctgttcagggattttggctgcattatgatttggttatgacataactcagttaaggaatatatttactaatttccaatgtagtctatgaggttcatttaatgtttttaaattttctatgtgtgtggctagaaggcatttgtagatatgcaaatatttgttataatcctgatcccttttataatttgagttattttcttgccctgggggtttacaaggacacgagtgcaacactctttatatggagaagacaggaaatagaccttgagctctaaacctttgcctgaccccctcttctgtgggcctgtgtttctggacaatggggaggtttacagccagtatgagcagagcagactgggagcacctcaatcctcatgcttatattagaaaatgccttagcaatgttgatgggctccttgtagcactggagcatggggagggaacaagctcactgatgtcatttatgcctattgtcttcagtaacttagaacttattatggtatattaaatcaataaaatgttggtgatgaacaatgtgttttgtaaccataaggctgaaagggacttccaggaatatccaatctatttctctcactttttataaagatttgtctaagcaactactctaaacacatatttattatctccatacttaagaatatctacgggaagcatatttgaaaagcatcattggaaatccacctcaatactagtgataggcctggagagaagtattgtatttatatatctcaatttatcagaagaatcacaaattctgtattagtttatatgattttacttagagaataagtatccatttacattgccataaatgtcacgatgaagaacgtgccagagatttcttatttatcactgacaggatgtcaactacatttttcatacattataacctaagtgtattttcacagctatagtccgagataatggtccaatttgttatcattttgctaatctattatagttgattattgtagttacaatgttgctatatatgtttatgaggtactatataaaatgtctgttcattcaaacttcaatcacagaagttagaagatggagaaaaaattatatttttatttgtcctacacaatgccatctacatctcttctcttaggaattgtgattgtaacaatgtggtggcatttgttatttcatatgacttttatctatacagtattctcacttacttacaaactattaccaacagcatgcattttagtatggcagatacaagaaatttgtgtgatgttcccttagaaaccaaatgatattaaattggggaaatggttttaacccactctgcaagggatactttaaaatataatttggcacctatagctcttgcattttaatattcttttaagctgctgtttggaagaaggcaccttataactagccattagcaccaaagcatcacgttggtatcaggattattttgatggagagaatgtcatcatttgcaaataaatcagttatctaacaaaatcagaatcccccaatatgtactcagaatgtactaccctgtatcttctttgtggaccttaatcattaggtaacattggccataataaaaaataataatatgcttcagaaacatagtagttggatctcttgtctatataacgtagagaaggggaagaagacatagcttccaggtaacatgggacccaattgcgtacaatctgcctttatattcatctcttgctctatattttaagtaatttcagattttccttttaatatctgattatgtggaatcaagtgagctttgatctgggactctgagacagacattgatgcctgagacttgagagtgggtctgtaggttcagcacttcaaatgttgtttcttacagtcttgcactccttcctcttgtccagtaacaacggtgtcaggacacagtagtttagtgtgaatatgtgtgtctttccaggaaaaacaaagcaaaagaggataataacaacttaaacaaaatctcattcacaaggggagcaagacttttaattttgcaaatgcctccaaagagttccagcaataaagcaaaattaaattgatagataacaaaaggcaaagccatggagaattctgaaaaccccaccaggctctgtgttttgtatagaatcatactgctgctgaatgaaattgtgtatctaaagtcgtaaggcatcaggtaggagctcaaaattatgaccataattaaatatatttgttgaaggctccttgggtccctgactttctgagagcaggtgttgtggatggttaaggcaaaaagtaaaacttttacacacaggtttctgtcttgtcattttgagaatgactcagtccattctggaccctttcttactccattctgtcactagaaaccatctcaccccctcacgcctggccacagcaaacagcattctctcttcacttctgaacccagaatggctacagaaagggttgctggtgcctcattcaggcggataggaaggaccacacacagtcaggcctgagcaacaatgtacttctgaagtgtagtaatgaactggatgtgccggggcattgattatatctgcagcttcaccctctgctctttcttcaaaacacagtctgactccaagcacttcatacagcttcactgaatgttcctttgaaattaattataaatgactctgaataggctttgggtagcaccaggcgtctttcagctgacaatatctagaaactcaagttcaagaaccaagccctatatcgtagcttagttttttctactattagattatagaccttcagctacaaaaattatgtcatttcagaggcttctataatcatagcttaataatagatataacccaaaaatcatgatgcatgagactgaattattgaagtttaacatatttctaaacgatttatgggcagctcttgatatgaatgttcctaaaccacaaccagctggtttaacatacacataaattgtgttcatgtgattgaacaaaatttattgttaaatgggtaagttgacctcagctatggactcaatttcaagatcctcgtagtggtgaatgaagagcagacactgatattacatacagattaacaatcttgtcaggctatactgagatagtgtgcaaaattccttcctcacacttgatccaaacaattgaaacctgcgtatgactgttcttccatcccttgttttcttccttcctttgttccttctttcctttaattaaaaaaggtcactgatacatttataacacaggaagtatcacagctaatcccatattctaaaatagttttataaagtgattaatatttttagtttgtgtgtatgcatctgtgtttattgaatgtagatgtttcatgattgaaagaagtaagtttctttggaaggacttgggaatgcagagaagtaaagtttgtgtctttatttctaatatgttataaccagatcacggtttcagttaagtacctcattgccatcccatccttaagaaatgacctagttcagtggttcagctgatctgcttggaagtatctggctggcttcataagaattccgtagggagttttaggaatacagaagactagtctttaccttcagagatttggattcagtaggtctcaggtagggcctaggaatctgtgtttagaaaatcactctaagtaatgctaatatacagccagacttgggaatcattgaaaagtattcaaataatcccaattactaggaataaatacaagttgactgggatagtgatgttatttcatttgtagttattttgaaaagttaaatactctaggcctcataccattatttctttcacaaattttaattttagctttgatttccaatttgtggtcttctttctgagcatgaatcttcaaacttagagacagacgtcaacactgataagcatgagggatgaatattgctcactatagggctattaggcatactagatacagtaccattttcttagttactgccagagctgtgcagtatattacaacatttgctaatcctcaccaccgaggtaaaaactatgacctttgggacacagaagcaaatatcaaagtgacagccttacttctgaatgctttgatttttatgtcatgaaaagacatcaacttaatacttagtctcactatgtacttttcatattgaattgtacattatctgaaaactgatttccaagcaataccgtgtaacaacctttcaagcaataatttaagccatggtgatgatgccatatgaagcttgcacttctttgcatttcatagagcctttgtgaaaacagaaacatgttttatacaagcaataatatagctggtgtggactttttaaagatactcattattctgtagcaaaatgagcagcaagtaatgactcagattaaaaatattcgggcaaatgacatgtttaatctatctcagaagttattcatttgcaaacatgctgtaaagtgattaatatacatcagattatttctggtgcataattttaaacatggctataaaaatatgatttctattcctgtcaaagagatttgtgtattatttataatgttgcccaatttttggatctttgtagtatataatagtaaggaagaagttaaggatggataaatgagtggaagtagagcataggttggaagaggtgattgagaaagtaggctttgcaaaaatatagatgggtcttgcggcagatttattcaaatgttggtttgatatggtcttggaagatgaaagagtaaagataaaagagctcattattactgttttcaatgatagctacacaagtttttggtaagtatgatagtattttgacttcagaatatgattgactgaaagtcacctgtagcacaataaataaaagtctgaaaatgattattcagtaatactgaaaaaacactaaagctttcagatttcgaaatgaaaaaatcatgtttttagtctacttaaaatacaattttaatagaatgtggcatagtcaatgataatcagttctttagtagttaaatttacttcatcatttagaataatgtataaggattacagctaaaatcaactagtaaatttatgtttatactgaacagtatctaaacatcagattatgatttagcatataagcttaggattcattcctaagcatctaaataagatgacagctcctattattgccctgcaaggtaaacaatcccctaaacatgaatatgaacccatttgaatggtgggtgtgttcgatattttgtctttacctttctattactcatagcaaaacttaattttagcattctcctgcccacagtttggaaaatttccctatcaaaatcaaaccggattgttgatttactgaggctttgacaattatcctcttgtatatcactggatccttaaatccttagtaagaatggttttgggttaaataaataatggaaaatatttaatttgaatctattaaattacactgaagttatccttccagttaattcagctagttgctgatcagatcattctttatattagacttaagtattgttgcttattatttaaaagcagaaaagaaaaaccaaatggcaggtctgagtaatagttactttttgattcttttgatacatatttttaaactgaagaaatcactttatattcagtcttcttctgtggactttttgctatttgcagataaagaaggaattctacttaatatatttttactgtggtctattaaatgtcattaaacctatatctaagaggaaagtaataactgaaataaaatcaggaatgtgcaaaattgtttcttcatacctcactttctgaagacacttctttgcattctgctgcctggcatttacacagcagactcaggacaaagggacaaatggagtgagtgaggtgggcaggagctttagaagagatgaagcaaagagagttagttttttattcaggaagatgtagagactcttaaaggagaggcaatttccgtaacaaacacctctggtttaatggaagccacatgatttatttgactactggtcactcatttttaaaaagaaaagagaaagacaaaaaaagagaaacccttcacaagccatttttagttttcctaggaggtagtgccaacctctcggcagctgcacatctcagtgaagctgggatagaagcttacagagctacaaatagatgctttctgaaggtggcagatagaactagtcttggttacaatgattaaggtaaatgaaagtgtcagaacatctgggttgaaggaacaaagaaggcccaataccagctctgccatatgccacagaaaaccctgctaaaattagcatagaaaaacagactaacactatgcaagtgatattaaaacaaactatattttttccttttataacatgcctggctgagctagcattcagtgagaagaatatacttttgtcttatgaatcatttaaaaacatttgttgttgttctgacattaaataaattacatattcccttagttgaaaaatttaatcacaaataataggaaatatttattttgtgtcctgaaatttttaaacttttggcggctgtactctacgccatattcttcttcacattcttctcaaattgggtttggctgctagcaaaacaagtgtggaactttagagcagaaaaatgtccatctgtctcttacagaatgtgccagagtatttgagctggagagagaatcaccccatagcatttaatggtattctgtgagacacgaagactctagtcttctaaacttaaaagtggttaggtagtaccttaatcatcaaagatttttcacttacatgtaactggttaattcatatagagtttgtttagaacagaaactttaaaaggagggaacaaacctgagcaatttttaatcaaaattatcagttagaaaaagaatttaagacaaagatttattgtcctgaaagagtcaactcactcatatccaaaacttagaatgtcagagacttttgaaagttttctgaatgtgtcaacttcttcagcaatgagagattcaattaatgttgtttctaggttccttagagttttatcctctgatgataacacttaattgtgaattacatttaagtgatttttactttatattttccatttgttacagaaaaaaagtcataaatatgacagacttaaaaattgtggcattgagccagggtttgcaaatttggcaatattattttacttaaaatattacactttttaaaataacataaacattaaggataatagtcaaataatactgtattttcagcttgttcacattagaatatagaacaacgcattgtaaacttctcggaataaaatctaagtcaaaaccaatttatgttcaaatcatttgaacaacaaatatgaatattgttacatcacctctgactctctgactagtaagaaactatgcatttccatacccaatgaaacctcaattcctacagcaattctacttttattgcctcccaagaactatttcttcatggtcaatatcactctttaaaagctagcaaaatatgactttcttctgaggtttgggcaatctggatcaatatttatgtatctaaccacttgaaaggctgtctccttttttggccttttaaattaaaacttccataaaatgaagcaaaatatgaaaacagctagttgatttatcaataatgtgaaaccctccttctgaatttttttggtaaaaattaccacactgaaaccaaaacttaaccttggcttggactctcagataaattgcttttgtattctttgactacaaagtattctcaaaaagaagaaattatttctgatggtagatcaaactctagccaagaaggtctagataaactagaggactgtataattatctaaagtaattcagggggacttttagaaaaattctttaatttttgttcctgtgtaaaaattattattaatggatggcagcccaaattactattcttcttttaaaatttgtttcaagtgtgtcaccaggcactcataaaattcatttatttgttatataactcaatgacctgaaataataggtgctcattgctttttcatttgatccttaaaaacaattttattctgtctaaaaaaaattctcctgctaaaatccaaatgattacctggctataggaggagtcccattttatgaacatgtatgaaatatttagttggattcagatgaaatgcaacttagagaaaggaatggataccagtagagaagatggaaagagacacaaaaatcagactttgcttacatcaaaattaggtctgttgtctaatcctgttaacctagaggcaagctgaaaatagatggtaaggataaatagatttttaaacacagtatttatatttaacagaatgtcataaaaatgacagaatgccatgaaattcagcatgtcaaaactttgataaaacaaacaagaaatttaataaatatgctaattagagtgaatatttaaagggacaaaaataacttgtcacatcatagatgtctccccagtgcagaatttattatctgctgggaaaatttggttttatgtcttcaatcaatatttgctgcattatctaattaaacattagtatattttttgtgctaatgagaaaccatgcaagagtccaaatatcaagtgtggtgacagcttgaatcagttgagtttggtgttcatgaataaaattcttgatgaatgtgaaatgaatggtttatatacataagttttatgtgcagtaaattaattaggctttaaaacttgttagcatgcttagctcctcttttttccattgaattatcttcctatcttccttccttccttcctttccttcctttccttccctccctctttgctttatttctttctagctcttataagataaatgacaatagtactttactatttgggctggagcctccctttttcactttcacatgattgaacactttgtggatttgtgagaaaaggggaaagaagatgagcacgtagatgcagatcagttgaggatagaagtgactgagagaattgggaccttgacttccagagactgtcagtcaagagaaatgtgggtctataaaaatctatgtgtgttcattttcattgaatttaaacactttttcaagaagtatcagggtcaatctgtttggacaatctcctatttttacccccttacaaatgtcttaagttagaaaaacctcttattttcaagtagtcatttttttttatgtgagtaccacactgctaaagactgaaatagaaaaaaaaaatgctttttctgtttgtagggaaattgctttctgaaaactactcccaataagatgtatacatcaaatgcaacttgattttactggctctttatctagagataactgatgcactgtcttctttcttagatacccttctgtaattcagcttggcatagtatgatgttttgagttcttattgagggtttggaaacatttgtcatcaattttatgtctactctattgaaaaagcaatatacaatgtattccatatttcttagctctgtgtctttgaggttttaaacctatattcagatagctgtttttagctacaattttgagtattcaccagaatttacaaattgccattttattaaatacaaaaaaaaaaaaagtacagcttggatcaagagatcaaacatttacaaatctcaatccaaagccattatttttcagggaaaattaaatcatttctagcagagtatttgactcctaagggaaaataagtcaaatatcttctttaagagtaagggcattcttccattgtaggtatttctaattgactttataataatttgaacaaatcttgaacaagatttaaagaatttataatctcccaaacttaaaattgtattctttctggttttttatttttatgtattaagattatattcaaaccacttaattatcttcatgacataagtttgtgttaatagaaaattatacagaaaaaaacatgatttgttcctctgtggaaagatatgcttcaatgagttaaatacccttgaattttggttctcatttcttatttggacttttctgttatgtacctcaggggtcttaaattctaacagatgaagtagtcaaaggggtataaaatacttgaaaaaaattaaaacttcaaaagggacgaatttctctgttaacttttgtttatcctatactgacttattttgaaattgtgaaaaaacaggcagctaccatataaattggtatctatgaaaatactgattactttcttcctgtgattttcactgttaagaaaacctttgtcttgaaatgatggacaatcttaatacttgttcagataaagaaatgtgactttcaatacctttaccatttgtatttctttagggaaatattttaataatgattgtaaaaatagaagaaatatggttgagaaaaatagaagaaattaagatgaaatttgaacagttgtaatccacagtcccatttttccctctattttattgccttctactaagttattgaaggcccagatctgcaaaatttacaagctactaattcattgtctcctttaagaatttggagcaaaaattattccgactatgcggaaatgaattcacatcatcatggcaggttttgactatgagggaattcaggttaggttcaaatagaataatggtccatggagaaaaatactttctgatttttcttcaagttggatggaaaggtttttctttatttaaaaaaaaaaaaaaaaagtcctcctgagaattttgccttcgaaaaagaagttttataacagctgcctgtagctacattataacttcggtaattaagtgacaaaactgtctcattatgcttttaaaatactgattaagtgcattccagaaataatacatatcattcatttcaaaatcaacctacctgaattctgactcttcaatcatgagtagccattttacaaaaccaaagggtctcatttcccaaacagtactttaaatatcatcctaatagtaatatcctaatagtaataatcctattaatactcacttcaatgcataaaataaacagccaatgcacttccatcaagtctgcaggcactatataataataaataggtttccaaaatcacttaataaaaacacacagttataatgtgctcggccttcattagcatcctctgcatggggtggttttcatttaacctgaattattttaacattttggctaatttgtttgctgcaatttcatgggtctaaatttttggtttggtttgcaatgtaaatcatattgtatatctgctcctttgttattagatttactttgtgaataatatcttttaaaaattgagttatcaaaaacttaaattataatgtcatcaactaataccaggtaaatatactaatatatatgtagggcatgattaaattgcatatattttgaaatgtcaaactattttttgtttttttaaaaaaatgaatgcatctcttaaacctgtaccattaattttaaaaaagtttcatttggtatttcatattatattttaaaatatttttctttatctagtagtacaggtttaaagaaactttttctgattgaaatgataaaatatgcctcatttcactagaattttaagaataatacatgtaaaagtataactcatataagattataaatatccacaatatcttctttgattttcatgtaacaccactttttactcattcttttatttgttattattcgaaatcattcacaatgtaaatagcatgtttcatgatgtaaaatgtctttgcatttacagactgcagaacaaggtgaatttgtatatgaaaaataagtgatggaaacgtgggattcttataaaacaaagtggaaatgatagttctgtgttatatttacataattcattacaaaattgtctagttaagtcatgcatttatttaccttaaaagtgtccaaactgtcacttataaaatatttaaatcaataaataataccaaaaaggagtctgaa

SEQ ID NO: 115 - DNA, 70353 bp, Homo sapiens
cacacagtgatttctgttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatggtgcgttttggctgctactttctttttcagtctttcggtgcggagaaggggaggaggcgggcagaggtctgaaaaaatcgaatgccttatggaaaggaactgcaagggttcctttggggtgatcaaagagggagacacagacacagagagacaaaggcaaggaggactgtctgggagccacgcgggcgatacagtttccgaggcacgccgcgtcccgcctagcctgttgaacaggtagacatgagcgacccaagcgtaagtgccgctgccgcgagtgcccagggtgcactcgcgcggggaccgacaggtgccactgcagggtcccctctcccgctcactgcctgccacccctgacgcctgctctctttctccattcgcagtgcggatttgcgaggcgcgccctggagctgctagagatccggaagcacagccccgaggtgtgcgaagccaccaagtaagtggtcgctgcatccccacgcgggtcggggttcttcagacaggcggtccctcttccgggacccccgcttgggctgggtctccttcctctcctgagaaaccttcggtacgctcccagttgcccagccctgggaagccagcatcgggttcccacgctggggaggagcgagaggaaaggagaggacgcccgaggggccggcccagggcccgggggacccgcggcgcccgagggaggagcacagacgggggtgggcgccgagcagcgccgcgccggctgctgagctcgcggggccgggccgtgagaacgcgcggggcgcgccggggccgctggtctcccacggccagggcgcctgggccccagagcccatcagccgcgtgcagcgctgcggcctccggcgcgccggcaggcaagcgagcgggcgcagctgggggatgcctggaccccggaggcagcagggctggaggcggtggcgggcttcagggcaacttcacccggccggctgcggcgtgggtaagaggcgcgtcctcctccacagcaaaagctgcgatcgctgggctgcccagagaaggcagccggctaactgcccagcggctccacgaggtgtgcgcgtgtgtgcgagagagacaaatgatttactgcttagcagtcccatttctgttttcgttaggactgcggctcttggagaaagcgtgagcagggggccaccgcggtctccgcgcctgtctgcaccctgtcgcctgagctgcctgacagtgacaatggtgtgaggggctgcgttgcaatgtggtcatgtgatttcaggctatggatttcgtgcgtctttctctgctcactgattttcacatggttattctttcattttgcactcgataaacagtttacatcttctgaagtaagccagaagattgtatggctcacttaacgatgactggttgaaggcatcttgatttggaacctatggaaacagtgctgagttttaaataggacagatttttttttctttcatttgaacttcatttataacatatcaatagtgatgttttaggatcagttctcctatggtaatttcactaaatgcctatttaatgaattgatttgatttcatacatctctaccacttactagaactgtctttgtacaaacgtcaaactttcctgttacatatgggtaagcatagaagcacttgatataatttttttttatcttggttcagagtgtagaagtggtctgttgcttttcctaaaattgctatacatattttttctttaagagtgatcatttcaggtaccctattatgtacagtggtaaaaagtaaactcgttatgatagcaacgacgatgtaaccaaaataagcaacacttaattggtctgaaagttatacatataagctttattattgcttcagtggaagttgtctatgcattctgtgctttgttcagccattaaacaactgggtccgtgatcttcttcaaggggccgtgaagtccctaaaattgtatttaaacattagagtggctgcattttaagggagatagtacatagtcaaatatccaaaatggacctgtgtcctaatagaaaattaagaaccacggggtaaaaacacgtaagccatactttttcttatcaaaacaacaggctgtctacatacagcctgcagacataggctagaaggaaaattctagaacaattaaatggtgttaccgtagttaaatatttcacataaaatagaccagatgtatgtattttaatgtattaggaaacaggtctgtgaacgtatttagtagaaatttgtaattaatagatgggtaccttatatttatatttataaggtatatttatactttatattgtaagatctctttctattatacgacagaaaataaaaattatatttttgtctttgaaatccaatcaaaatataaagtacttatgcttggtatagtgtctcatagtgtatgaaatataaatagccccttaaaggtcttgcttctagatattcaggtattaaataacatgattaaaatcgttttctgtcattcggagaatgaggaaggaaatataaaattattttatttatttatggcaataccaaaaacaaaagtgtgaaaaacttcacaatgcttagtacttataactcttataattatgtcttattaagggatctttcttaagacattttgaaaagctattttaatatttcactacaaacaagtgataatattaaaattaaagtatatctattacaaatacatcagtaaaatattttgtgaccgaattttaagaattttgttatatttttcaaatgaaattgaaaaaaattaaatgtttatctaacatcacttttattgacacattgatattgcataactttgaattttttcagaaactatacaagggaaattaaatcctgcatttacatttgctagcaactaatgagtgtggactgaggataatatttcttgctttacaggttagtttaaaataacacgatctgcacccccataatttctaattaaccttttttcagaactaaataaacatcaaattagccatcagaatgaatctctacaagtaaggggaaatggaaaggtaaagcaacatttcagtaatacaagccaaaaagtatgtgcattaatgggaaaaatttttggaggaagctgttactgagaatgactttttctgtcagattcactaagaagttgcttggcttttatttgtgagaatattccattttgaaggcactatttttacactggttaattaaaaatatttacccaagccacttttcttaaacatttctatttattacttttctgcacatttgtaaaaacaaattttttccccaaagtattaataattaaaaatatgtttgtctcttgaccatctacattcattctgcaatagtttgttttgggtgtctacatcttgacttgatataagaagagcttttgtcaatgtttagttactagttgatttactttgggtgaagtaatttcctggctatcctgaatcatatctgcttcttttattttctttcagaacattttgaaatgtcttacctattatatatgtaatttttcttcttccctgggttcatgccaataggcttcatcttcctatagcctcgaaggcttacagaggatgaacagagttattttggaggggtgaaagaagagctgtagagtgggcttccctctcagcccacagtaggagagaatggctacatcttaaaacttgagggactctggagcaggctcttccttgccacaagaatgtgcctcacagcctgtagtttctaacttctggtatgctttctggccattaaacaatatttcattaaaacaaatcctccattttaaaaattgaggccaagtcaaattaattaactcacataccaagtcatctatctcaccatactaagaattagcaggaagtcgacacgagacaatggctttgagagtgaacaccttcttaggggggaagcaaatggggcagacccatttcttaatcctgacctttttttctaggtccagcctatctatttatccccttttgctatgtcacatgacattgaaagtacctgtttaaatgtctgcatctcccattaaactcaaatctccttcacggtatccaatgttggatccatagtgcttggtgcatagtaggtgtctaaagagcttaacattgttgtcattgttattcttgaattaaggcttgtttatgctttgatgctaccacatggagctatggtcttggtgacagagacccttgtgtgctcttccgtcatatagtttgtggcctcttcagaattgcttgtaaactgttatttatttcaccaacaattttaactctgctccaacccttaaatctcttgccactagacctaccagaacctgccttcccaatgtcagcttcacttttaatgtttgctttaccttccttgctgttgatttagctggacaaagagagacataactgtatcttgtagccaactaccaattgcttcactccaatgtcagcttggaggatactttgtgcagctattttattcttttttagttaatgtcatatcaaattctccatggtacatattctggatttttccaggttttctagtctgcccagattatctccagactcttcattcttagcagaggaccatactttttaattcacagaggatgttaaggtcagtttgggcaaattatttgtcaacactcatcttgaatacagtaagcatttctttgaccagctgtgagcataagaactcttttcttatattcagctatcgaatttgtctctataatatttatatctttaattttttacctcttagagtatttatagaaaatgcttttacatctaacaactcttaatagtgtctaagataatattcagtttcttcaacccatgcttatttaccatgggttgagagtctcattgttaccagggcttttctcttttggatgcacttctgtttttattaaagtgtgatccccagagtttaacatagaggactgtcctctgatatatttatcttctctggatatcatgtagtaaatcaacctgaaatctattctactcttcccccctccgttttttttttgcactcatacaacactgtttaattatgtatcttttttgcacattcttctgcaaatacacttattttccccatcgaattttatgtttggccacttgatttgggacttttacaaatacttactgcaattaaatttaatcattacctttagttagcctgttgttccagaaagtcaaggtcatcttggattctgagtccttgatacagaatagccattttcaccaatttagaggaattaacagatttgatcaggatataattaacatcttcatccaagtaactatctacaatgctgaactggaactacctttggcatattcctagacaccgtcctttacgttagactcctgctttacattagtccataaattattcctctttataaggctgttcaaccagttatatagtcaaataactctctttgaagttgacattcctttgtgtgacttaagagagtatactgagacagacttggtcaaattcctccctgaaatgagtctccactttctgcagaatagatgtcaagtaactgctattaaaaacaaaaggagataactaggttagttgacaaggataggttcctgtgacctctccttatcttgtagataacagcacttcacattttgaatgcttgcatgccatgtttttaatcatctctttggaatagtacctgcaattaatgtccagctctctaaattatagctgatggaatccaccttcccaattttgaaaattgaggcaatggttggactctgtcaacacttctcttcatcacaatatttttaaagatgactttaacaattcctttattttatccacacatgctttcaatattttgtagtgtaatttctccaaattaatggatttaaactcatttagaatatttgctatcattctacatgctggacctttgttatttttagttttgttctacttttataagtatggatattgttttcttaaggaatggatatgaaacaaaacaagagcagagtagttctgcctgtttgttcatgtactgtgatttgaatatctttatccagtgtgctcttcctatatctaataaaaatgccattatcaccactttatctggcaatcatagcaagaattaaaaggacattttttcttttttttataagcttcaacttattttatgtcttatattttataacactcttcttagagactcagccactattttgtacttctctcaataaagtttattatggattatgcttgtcactgaggaagatacaaagcaaagtttatgacacacactccttgacttgaaggaatttaaagtctgcatgaacaaaaccaagaaatagtctcagaattatacatgtcagcacttaacaatgagcataatatttgtagaatagttttaataagttttaaagaagttaggagaaggaagagagttcggtatgatggaaatattgagtaaggctttccagaggaaatctaagacttagctgaggttttaaaacaagatcaggatgttggacatcacaggacctgtaggatttaaatgtggcaaacagtaggaagagtattctagacagaggaaaggaaaggattcactgcagggatcagatgtgtgtgtgggtgtgcatgtgtgtgtttgatgtgtgtgtgtgtaccctgtgtgtggcggaacgggtaatgctgagccttcccaggccatagctttgaagtatttatttgtggagaacaccacttttccatttctagcttttcgtttccccttgttcaatctttgtggggcccacacctacacatcttgtagatctcaaactaagctctgcttcttaaaacctttccctgaacttccaagcctaaattgcatgccttattatgttttcctgtaacacattgtgcttcctttgtagaattattatgatatgaataattacttgctgaatttttactattatactgatacttgtggagagaggtaccatttctgtttagttccccattttatacacagtcatctaatacaagtgctcaatggctcataagcactcagtgaaaacgtgtgctatggccgggcgtggtggctcacgcctgtaatcccagcactttgggaggccgaggcgggtagatcacaaggtcaggagttcaagaccagcctggccaagacagtgaaactccgtctctactaaaaatacaaaaaattagccgggcatggtggtgggtgcctgtaatcccagctattcgggaggctgacgcagagaattgcttgaacccaggaggtggagtttgcagtgagccaagattgcgccactgcactccagcctgggcgacagagcgagactccatctaaaaaaaaaaaagaaagaaagaaagaaacaaagaaacaaagaaaacatgtgctatcatgagcctacttggaacagtgaagttatgtggagagtacttgtaaaaaaaaaatgtttaaaataaagaagggttagattacaagtccagcatcttcgttctttatatgcttattctaacagattttttctatttttaaaatttatttctttttacatcttaagcttttttattaaaaataaagacaaaaacacacaccttagcatggacctacacaaggtcaggatcttcagtttcactgtcttccactgccacatttctcactggaagatctttagggacaataacaagcatggaacagtcctcgcctatgaatacaatgccttcttctggaataccttctgatgaaactgcctgaggctgttttacggttaacttatttttataagtaaaactagtaccctctaaaataacaataaaaggcataatatagtaaatacataaaccaataaaatagtactttattatcactatcgagttttatataccgtaggtaattgtatgtactatgctttttatatgactggcagcacagtaggtttgcctgcacgaacatctccacgagcatttcagttatgcattgtgctatgacattacaatggctatcagtcactaaggaatgggaatttttcagccccattataaacatatgggaacatgattgtgtatgtggtccatagctgacagaaacattgttatttggcacgtgacagtatatgcactggaatttttagctgcttatttttctccatttgcaatatcactttgcagcttcaaatatgctcattataagcagttaaatgatatgtggtttttattacattattaagttaataaaataagtgacaaggagtttcagtattccatagtataacataaacttttaaattgtgtatttgtgagcataaagttatatcaagatctttagcactatatatgaagtatttagagagttacaaatgtagcattgaaggaaatttgggtaaatgcaataaaattgtcagtacatgagttgtaaagcaagatatccatatattagattagcactatacatttgtaaatatgattagcaaaaggcaggcttcccagcgaaaacaaacgtctttgggtaaaattctatttcttttaatgttttaaaatatttgtagtcactaattgtaagtcatattcctctttgtccagctctatcccaaataacaatttaatacaccgcagcatctatttctgcttattttctgtgtcactggctcagaataattcataagcccttgttgtttcatcttatgctaacaaaaatccagcagtggtatgtaggagagctgtgatatgccctgataagagtttatactttggagaacaaattatcctaattaaagtcactgcttttcttctcttctctctctcctcctctttgaagctgtgagagtttatcttaacctagactggttaccacctatggctttatggcttgcctgctggcttggctgagagcaagaaagttgtatatgagggatatcacaaggccaccttccacaaaaattgctctcccacttggtcctgtcctaaggcctaaatctcctttgggttgatgcaatcttttggagtgtctcctggagtcaataagatgcctgttttaccgtgaagagcagcacaatgaagaggttgcccaatagcagtggttacttttattatgttgtctttctgccttcaatcaagagcatgacacttggacatagctttttaaagtaaagagaaaaaggaaactgaaaggctcagtatgtgggacatagataagaaaatgagacctaaatagggtgtattgggcaacaatacagggcttaaatagaaagaggaagaccaaaagaaagcaaagaatgtcctaagaagagctggtttttttttttttttttttaacaattttgttgcctattagttttcttcattcctggggatggttgggacatttttccacatcggcatgttatggccttgattatctacctaaatcaaaccagaggaaaatcattttagtttatttttatcttaacattggatctgtttcagcgcgtcctggaaattagtagttgcatgttgtcaccgtctattttgtacacagtgaaaaggtatttggctgtgtttctatttacattcactgtccttgataaatactaattggccagtgattgtaagtctcaagaatttttgctgcagagcgtgtgttaaaactcattttaagtggtgtaggagtcatgcagtgtttatcacttaagtgggtaatctgacagctgtattttactgcctgactgcagctttattcttgatcattctcttccttgagtagtgtgttatggtcatgttgtcttagctgcaattaattcccaacctttttttgttttccagtctttgtcttttgcatttatttttctgctcctgcaatgccttactttgctgtctctgcctcgctatttcctatttattctacaaagctcaccttaagtgtcacgttttcagggacatgtttaccaatgtactgtacaggggcacatgcagattcttcatgtccccatcacaacctgtcatgacatcacactgaactgagtttgtgtggtctaagtctgtccgccccaacctttactcaaaacgttccttaaggaactaggattggattgtttttatttctttgtttttgtttttaatccctgaaatttcgtcctttagaatgtagtaataggtacctaataaatatttttggcatatgtgaatgaatgagtgagtgaataaataatcagattagttgatgaaagattctaagggaagattaggtaatgtgattataagagaaagatcctgaagaatgcttgggaatggatcctttactcatacatgattttgttcatcagcttatatgtaggatcacagtcatttggaaaatattggtccattgaaatttatacattttccaaatggtgacacacttcattatacagtgtcaaaagttagccttcatgactatcaccactgatctcatcaggaagttttaagtattggatagctataagctcacaatggcagtcctagatagtgcagccgtggattgaaaaagtgttctagtttcctctttttaagccaagaatccatccttaaatataagaagaaaatcaggccgggcaccgtggctcacacttgtaatcccagcactttgggaggccaaggtgggcagatcacctgaggtcaggagttcgagaccagcctggtcaaacatggtgaaaccccatctctatgaaaaatacaaaaattagccgggcatggtggtgggtgcctgtaatcccagctactttggaaactgaggcaggagaactgtttgaacctgggaggcggaggttgcagtgagccaagttcgtgccactgtactccagcctgactgacagagcgagattccatttcaaaaatatatatatatgtatatatatgaaaaaatcaatagacttggtcttagaataaatattaaaatctaaaataataagtttatataaaaaattagcaaagtggaattacttcttatgtttacatttaagaccaagaaaaacttcaagatttcaaaataataaattattagacaataatgaaattacaaacattataacaagtatactgatagttaggaaaaataatagagttctgagaacaaactgcgttaatctccaaaaatgtacacttatactttaaacctactaatttagaaaattctacacaaatataaattccattagaatgattacatcatcacatgtcatgtagtctctggagaactctgctgcaatctgtgagagaatgagaatgaaaaaggtgcataatattagaatattgttatgaaaatagttctgaccatgcatatcctctgaaaaggtctcaggacatccccaagagtttgcaaaccacatttcgagaaatgctgctttaactcaaatgtgtcttgaacaaggtaaacataaaggtttttacaataattttatatcaagtccagtttataatagtgaacatttcttaggtacattttacattccaagcattaatacaactgcattactttaatcaaatcccttgaggaatgttctattctcatcactgttctacagatgaaaaaatggatgatgcacagagtagataagtcacttgcctaatgtcatacatttaattaataatggaaccggtatttgtagccagggagggttcacacttttacttactatggtaattactatggtaacctttctgcccacattgcaagttttcctgatgatttgtgaattacccaagttttgcttataaacaatagcatttgttgaatgtctagcattttaagaaactgccaaactgttttccattcccaccagtaatctgtgagatttccagttattccacattgccaataactcttgacattgctgaactctagaattttagccattctaatgggtttttgtttaataactaataatattgagcatatgaagaaatgtttatgactgtttatataccttctttaatgattgtctattcagatgttttgcccattttaaaatggaattgtttattttcttactgagttggaaaactgtatattctgaattaaactcccttgctgttgtgtgttacatatattttcttctagtatatgacttgtgtttttgtttatgtaataatgtcttttgaagagccaaagtattttttttattttgatgaagtccactttatcatgctctttttaaatatttcatgttttttttttcaaatttaagcatctttgcttcaaacctggtcacaaagaatttcttttatgttttcttctgtaagttttatagttgtaactttcgtacttaggtttacgatttgtcgtagtctgtttattttgctataaaagaatacccgaagttggataatttatttacaaaagaggtttatttggctcaatgttctgcaggctgtgcaggaagcatggcaccagcatttgcttctagtgagagcatgaggctgcttccactcatggcagaaggtgaaggggagccagcgtgtgcagagattactgagagagagaggaagcgagggagagagagaggagacaccaggcttttgtgtaacagccagctcttgaaggaactagtagagcaagaactcactggctatcgtgagaacggtgccaagtcattcatgagggatctgcccaatgactcaaacatctcccatttcactccacattcaacactgaagattagatttcaacataaagtttggaaggttcgaatatccaaaccatggcatggtccattaagatttaatttttgtatatggtatgatgtgtggataaaagtttatttctatttctatatggatttccagttgttccaatggcatttttattaaaaaacaaacaaacatattttctttcctgattttattgccttgacacctttgttgtaaacacaattgtggatctctatctcattgatctctttgtcacccctttcaaactgatacctcactttcttgattactttaactttttaagttttgaagcaggtatataagtccttcagtgctattttttcttctttaatattaatttggctatcctatgtcatcaatgaaatcttagcctcattttgtcaatttttactaaaatgatggctgagatgttgattggaattgcattgaatctataaaccagtttagagaaaatttgtaccttaacaatattatacatggtatatatctctccatatatttagaccttccttaatttatctcgtgaatgttcgtagttttcagtgtaaaagtcttgtaagcctttggttagatttattgctaagtatttattaacagtatcataaatgagtttttaaaataattattttccagtatttgtggctagtacagaagttataatggaattttgtatatcagtcttgtatcctgaaacattgcttaatttacttcttagttctagttattttgtatatccactgggaattcctacatgaacaattttaagtatatgtgtgtgtgtgtgtgtgtgtgtgcacatgcatgtgtatgatccttgaacaacacaggggttggggcactgacactcctgcacagtcaacaatccacataaaagttttgactcctcaaaaacttaactactaatagcttactggtgactggaagctttaccgataacataaacagttgattgacatgtattatatactgtattcttaaaataaagtaagctagagaaaagaaaatgttacaaagaaaatcataaaggaagagaaaatatatttaccatttattaagtgcaagtgggtcattataaaaaatcttcaccctcgttgtcttcattttgagcaggaggaggaagaagaagataaggggttggttttgctacatctgggatggcagaggcagaagaaaatttgcatatgagtggacccatggagtttgaatctgtgttgttcaagggtcgattggatacacacacacacacacacacacacatgcacacacacacacacatgcacacacacacacacgtgcacataaacctgcaaccttttggccttttgtttaactgattgcaatggctaggacctaacttctgtacaatattgattagaagtggtgagagcaggcatctttgcttggtcctgaataatagtggaaaagtgttcagtctttcatcatcaagtatgactcaataattatagttttcatagatgctttctgatgggttaaaaaaattatgattgcagagcttgtctcacttgttctcattattagtgttggagtgggagtctcttgtgactttctgcaatttaaccagaagtcaaagaccctgtactttgagctaacttttgtgctctgtatagtaagtatttctatttacagaaagctacaaatataggtaacaaaagaaaaggatttcatatcctcacaatccttctttcaaacttgctgtttcccaatccacagatcttaatgtaatctgtactcagttacagtgtagtactttatcactataactccttattttcttccactttcagtctactattcttattcaaaattttgccttaaaagccataaacatctttctaatttaaaaatcaaatgatattttctcagtcctccttaccctcttcagacttgtgacatacacttcttttcgaacacgtgtcctctttcatattcattctcattgtacttttctaattgctgcttctctgtcatagtcataatactttctccagtccttaaacatgaggattccctggagttctaaatttggttatcttctctctatatatgtagcctcttgatcttaaacagttttagttaaactcctgactataatggtttctgctatggggaggagcacaaattcatctctaatctgttacacatttctgaagtaaatactccgattttcaaaagcacctccaccctagattccctgctacctcagttcaagatccatgtatctaaaacaaattcaacatcctttctctcaggcctactgctctgtttctgttacctgtttccatgaacggtgctatatctttctacacaaaacttcagagtcattctattcctcagatctagtgagttgccacatcatgccaactttaattttataatatctctagtagccatcttttcctgcctctttcccacaatttccttcatttcttgctttcacttacactgttctttctctgtggcgtgccccttgccaaaatcttaattttcagaacttagtcatttaaaaaaataagctcaaattctgtacattccaagaaggcttccctgatgattcttttgccaccaccgcctaaatctgatatttcttataaacagttttaactctctatctttacttattctccctttttattgtagccattagctatttaataaaatttcttatatatacataagaaaattcgactgggcacggtggctcatgcctgtaattccagcactttgggaggctgagcggggcggatcacgaggttaggagttcgagcctgaccaacatggtgaaaccctgtctctactaaaaatacaaaagcattagctgggcgtggtggtgtgtgcctgtaatcccaactacacaggaggctgaggccggagaatcgcttgaaaccgggaggtggaggttgcagtgagccgagatcatgccactgcactccagcctgggcaatagagtgagactccatctcaaaagaaaaaaaaagaaaagaaaattcagtgtgtgtgtgtgtgtgtgtgtgtgtgtgtatataccccactcatatcaggctttgaagaaaattaaagaaaggaatattttttgtccttttatgaaacagtaaattttgattgaattataaatggatctactgacaactcattttaaaatgtatttccaataagcaagacattttagaaactctgatttagctttcttttatttgtattttatgttttttctggttcatgttttgccccctatattgattatagctaatagcctaatattaatatattttattgagattagttaatattaattgagtggccaaatgatggatgattctgtgctgagtgtttctgataaggcagtcaagtatagaaacatggatggtttttcatttagctgatttcacagcaaagtgcaaaaggaggataggaaattacatgagcattgttgatttctttatcaagcacagaccttggaaatgcataaactctatgtatagtgagatttcactttttctgaaaaaagttgaaaaacaacactaataataagtaaaatagaaaaagagaatatataggaaaacaaaaaaaatggcttgtcaaattgtgtgtcatttacagaggtgtgtttgtgtcttcacatacaaagaatccagggaaaataaatggaaaaaaattgaataaatttaataataacaatttagttagcctatctatgtcacttccgtgtttataccagatgactcagagccagtagttctttcaatttcagcagaaaataattattggcagtcccaaagttggataaactgtgacctgcattggctggtttgattaaggctggaaaatagcaaacttgattaagtgacaaagacaagataatgaggaaagttatttagaaaatgtgtttagagatttgaaaagggactaaaagatagtttctcaagaaagtgcaaaagaagatgagaaaattatgaaaaagagtctggggcaacattttaggaactgtagacagtgaaagcaattttataatgtatgttaatattagcatgatatatagacgaaaggtaatcttctgattggtctgagatgaagtagttatgttaaccctcaaaagatgatgaagtgtgaaatttgaattcagataactaagttttcaagttttctcaaagtattccctgcagtggctggtggtccacaaagaaaggagggcttctcagcattttcagtagaggaggtcatcagggtatattgggtgaactcaatacacctatacacctcctgagctttggggtttgagccacatcactgaagtctgcactctgtcatctgcaaatggaagggactgcaataaataatctctaactcctcttccagttctaaactcctattatgcaaatgactctgtctttatattgacttttatgtaagaggtactgaaatgaataggaaaaattgtttggtatttctttaaattttctctattttgaatcaattagatggcagaggcattaaaagaatatagttgtgggtttggatttaatgggaaaagactcagcctttctcaatatggactttgcaagcatccaaatatatacctgcaaagtatatgttcagaagtccaaattcatttctggtaatgattcttctaaactaatcattatgtaaaaacttggcagaattgagtttgtgttggaatttgccacgtcttttgctaacctgattccagcataagcatcaaggatctgtgtcccagtgttatgacaaaagttcatttcctgtcttaagaatcagaaagagctttactgctggtcagaaaactagaaaaggtacctgactacccatcaattactaataccttagtagcctggtcccctgggccacctccaaagaaacatctgctgagtctccaggcctcgaatctcacacttcacttttatgagccttttctctggggtcataaaagaaaatttctctgagaaacgtactttgccaaagtttatcccttggctttgttgtaaagatcctttaaatgtggcagagacaccaacagcctttttagctgcctttcaattcttctctgatgcctaaaactagagaggctcaaagtgaagttttcaaagggagtctccttagagttcactgggaccctggaagcatctctcatgccttcattttgggaatatctaaacttcattaccttaattgacatgcccaacaacctgatctttcattttattctgtacactaatttaacagatacaatttagtctttgttttcccagattacattttttagtaggggaacttgaataataatcaccatgatatgtcaaaagctcctggtttctcaaggcagctccacagcaggagctctgtagttagatagggttgggttcatttcctgtttctgccactcaccagctatggccaaggacaagttacatgatcgatgtttcagattcttcttgtgtaaaaaatactaaaatacacaaacacacactcacacacccttcccataagattgttgtgaagattaaataagataatgtatgtgatgtccccaacagctctttaaagcaggagtcagtcaacagaccccatcaaggacaagatagtagctacttaaggctttgccagtcatgtgacctccatagcagttactcaactgcacagtttgaacacagtagccatagacagtgcataaatgagtgggtgtggttgtgctccaataaaagtttatttatggacatagaaatttaggtctcatataatgctcatgtatcactgagctcctggtgttctcctgcatgacagcttagctttgtctgaccctctcagccctgctccagcttccgcagctcctccaccgcctgaaccgcctccattgatgcatctgttcttgttctccttgtgttttttttttttttttttttttttctctttgctgttctttctgtagccaggcctatacttctccattaatgtgttcttgattaggtttggtaagattctatctccagcattgcatagatgtcttaatttttcatagctgtataagtttcttgtcctttctctcaaagagcttggaaaaatttccaaaggctggattagaagaactgtgagagtcactagtgtctcttattccagaatcttctttccaaatatgacaagttagagtccagccagtttgtctttcccctaccattcggtgagttctgtactcacaaggtcactccttccttcccatcaaggatgaattgaccttggtatctcctcattgctcagaaaggtaattcaagtgttccacaggtcaatcccagagtcacttcacttttgtcaggaatccctgtgtctcttactttaactggactctgggtgacctatcttgtttgcacaaatatcttaaagtgaacatgccaattagtgtctcacctctacctgctcacaacctaaacctttccaccaaactaacattgagaaagtaagtagataaaagaattattggccaggcgtgatggctcatacctgtaatcccaacactttgggaggccaaggtgggtggattgcctgagttcaggagttcgtgaccagcctgggcaacacggtgaaacctagtctctactaaaatacaaaaaaaaaaattagccgggcgtggtggcgtgcgcctgttgtcccagctactcaggaggctgaagcaggagaatgacttgaacccgggaggcagaggttgcagtgagccaggagtgtgccactgcactccagcctgggctacagagcgagactccgtctcaaaaaaaagaattatcactgaatccatatttagaagaacagttagcttataaaagcaataattagagacaggattccttgtataacaaatactaatcatttcccaatatggcattctgggaaaataaaatcagataccacaggatttctatttaagtttggttgttatgagattttgttttgttttcaaatttccacattgggaataatatgaattaataaaaaatagtgagtagtgcaatggcataaggcttgcttgatttataaaatagttttggcttaacgagtagaaaatgaggtttaaaattcaacatagtcacccagtttttatattctaatatttcattaaaggaattagacatgcaacttattatataatagaattagataagataaaaccaaaatagaatctttctgctctaagctgtgctgcaaattctataattttttagttcaataaaaagaactgttgacttagatataactttcttggtatattctctaatgctcatcaagtaaagattgctttctatatttgtaggataatgagcattggatatattattagagttcccttaaacaagctttgatgcatgaaaaaaatggtttcataagtataaaacattaaggaatctttctgagaagctagaataaaattgtcaatcatttatttaataacttatgtcagcacaattttcttgtagtatgcaatgagcatttacatttggttgtatgtaccaaaaaaaaattttagggttgctctgaagttatcaaggagacactgatcatttttttcctgttataaaaagttgcctagagctctagtagaagaagcatcacagctttcgtaaggcaagtgactgaagacttgatccaagactggacttttatctttttttaaaaaaattatggacctatggatgctaggcaagaccaggcactttatatatattattccaaattcttaatttgaatctgttacatcatgactttaccattttatgtgtgaaataacagaattcatgaagttatgaaacttgtccaatgtcacactaccaccgagtagcatttgtgatagtcaacatgtattcctcccatactgggtagcagtgcttttctaagtgctttctatttattgctttgtttaatctcacaacacatttatgagatagttgctattattatccttatttttcagatggagaaaattgaggtgaagttcagttaagaacttcactaatgtcgcagagttagcacatggtagacgcagggagcaaacacaggccatctgttcatgtagcctaagcttttaactgctacgccaactccactgcctcagggaacaactgggcatggcacctacatttatgtgaacccaaccctccaaattatgaagtctctgtcatgctaattatctgcatgagacatgagacatcaggcacttaaaaactcaccattacagggccgggtgcggtggctcacatctgtaatcccagcactttgggaggccgaagtgggcggatcatgaggtcaggagatcgagaccatcctggctgacacagtgaaaccccgtctctactaaaaatacaaaaaaaaaaattagcctggcgtggtggcgggcgcctgtagtcccagctgctcgggaggctgaggcaggagaatggcgtgaacccgggaggtggagcttgcagtgagccgagatcgcaccactgcactccagcctgggcgacagagcgagactcctcaaacaaacaaacaaacaaaaaaaaaaaaaaactcatcattacagaagagggaaaataagggtgtgtgtatgtaagtatgtatgtatgtgtgtgtgtttatgtatgtctctacatcaaggatgtagaggttttactttacttccaggccttcctgcctgaccaaaatttaaaagaggagaaattatgatgtcatgtaatcatcaagttcattatgtcacctaaaagaaatctatcaattagcccaattatttaatcaaggatttgttgtcactttaaaagtttcatcagattattttacctaaattataatgtactctgtggagtctcagaaaatgtgatcttgttgagtgtttcttccaggttggtaggttggcttttcaccttatatgcaaatttaaatcaaacattgattagtgtaggagtatttctgatataacacagcatagatgttcttggaaaacctcatatgcttcaaaactgtgcactaaaaataaaaggacttagggaaaaaatgtgtttgagtgaaatcattcaatgcttacgagcactaacaaaagcaaaaaagaaaaaaaacaaaacaaaacaaaatccccaaaatataaaagtttagttaaaagatacattgaattctaatgaatactgcacctcagcaattgtaggccttgacctaaggggaaaaaagtgaaagtagttggtaggaaagaactataagacagccttgagtctgctgagttatggagacaagagaaaaatacaggaaaattgtccaacagtacttctacgacagagcatatggtcagactgggctaagaggaagaatggggagcaaaggggatctagcatgcctgcattttatcctgacattatttccctagcgatagatgtgcctgagccaattgacattcctgaaatgtacagtacttatttgaaaacagataaaaacaaaatggctttttacagagtaaaaaggaattacatttcttccttaactcatttcataatcattactatattttcagtaagtatattttaaagtgactaagcctctgcaaggaactattttagcaatgtaactatgatgagaatcatagaaaaagatgcaagaaattgttttatatattttagggaaaattggttgaaaagtttatctgatttcctcatgatcagcatgatgcatcataagtagtgatgatacttaatttgaagatgtttaactgcatgtattcaaattgtagtcatcacacgggagagtttttaaaatatattttaggatttataatcccaaaggtttttctcttaaattagttataaaacattctgtaaatactttgataaaaactgagaaacaaaatgtgaatttgaatacttaaaatctccctactatagagttgagtgtactgaattttgctattatttcaaagatgccacagaattgcctcttaaatctaattttaaaagattgtagattgcactcatcttattttaaataaagatttaatgcagcttattaaacacaatttgtgtccagtactgtagttttatcaaggcggttgccacccggcgagtcggggggcaggggcactccaatatgattattgaaagtgaggttgccgttgtctttagagttgacctctctgttttgggagaatcatcagtatgggctcttgagttacaaaaatttaaggtaagcatcctcctctttaaaaatagcttgagacagctcacacttacatgtagatgcagtccgttaggaaggtgaatgccctactcagtaatagaaattggagtgaacaattactgggcttttgaacaaggagaaattgcttcccaaaatgagattttaacagaagaattggagtaacctaactcccacaaggtgttatataatattagaaatccaagctctaggcttggttaagattgaataaccagagtcatgggaaatgtattatggactattttgattgtgcactatggtccctagagtttttccttggctgggatattgagaagtaaagtcagaggaatgtgtcttccctctgctttggtccccacacccagtcagtagcccaggcctgcggattctctctcagaattacttctgcaattgattcattttttccccccagggtcctgtttttgcccaacccagatctaccatctgtcctactctgacccatttttcattctacattccaaataatcttctaaaaatgcagtctaattcacttactctcttgcttattagttatttagttgattgcccttagaatagagtattatcttgtttaatgcggtttgtagaactctgcaaaatcctgacctctgtctattttgtctctcaccaccattatcttgctctgtcttaacctcattcatgcctttgctacactggaattacttctgttcctagaacattggctcccaagcatgctgttctttctggaactctcttggcctgacgcagctcagatgtttctgagaggactaggttcagatctctgatttacattcccagagcactatatccctcccctttttgcagcagaggccacccttggaactgatacatcagaaatagttttcctcctggattgtaagttcttgagagcaaggggtgttctttacacatcactctgaccttgtgtctagaaaaatgcctggcacagagcaagaccttcgtaaatatttgttgaataggaagaaaaatgaacaagtgcatgaatgcgtgaatgatgtagaagacaatccagtaataccaaagaatctattggaatcaaaattattaaaaagaaaatgcagatgaatggagaatttatgttaaaagccaaaagagtcttgagctttgacttttaggcatcatcaaatttaataaagagatatcagtaacatactaaagcaaaagccagatggttttgaacttaagaataaatatgatgtaaggaaatgaacacagcccataaagccaacctttcaaaaagagtaacaataaagggagaatggtagtgctagagaggaatgatgggatgaaggagtctgagatttgtttgtctctttttaactttgtggcagagagaattggacatgctcaccaatttttctactactttgtcctgctttcctgatataccacagggaaagttctataaacatttcctactacaaagtgaaaagaaacctattttaaaagactggtttatgggattttatgtaatatttttcaatttttgagtaaggaaaactttctaagttttcagtctacctgaaaattaagcctttttccttatttatgaaaatagttgttacaatttgtactgaagtatacaaactttatccttactaaggcaatttgcttttaagttttctcctccttttggctactcttaaaaatctggactttcaagtttaatcttaaaaagctcatatctttttaatcacagatattggcatgtccaggtaccaggtatgatggtagacatttgatacagctaattgcttttgtgatggatacataatttttaggcttgcctcttccctgtaacttttttcgatttttttattatttatttatttcaacttttattttaagtttaggggtacaagtgcagtttgttacataagtaaacttgtgtcatgggagtttgttgcacagattatttcatcagccaggttttaagcctagtacccattagttatttttcttgatcccctccctcctttcaccctttacagtccaaaaggccccagtgagtgttgttcccctctatgtgtccatgcgttctcattgtttagctctcacttataagtgagaacatgcggtgtttggttttctgttcctgggttagtttgcccaggataatggcctccagctccatccatcttcctgcaaaggacatgatctcattcttttttataactacatattattccatggtgtatatgtacgacattttctttatccagtttatcattgatgggcaattaggttgattccatgttttactattgtgaatagtgttccaacaaacatacgtgtgcatgtgtctttataatagaatgatttatattcttttgggtgtatacctagtagtaggattgctgggtcaaatggtatttctgtctttaggtctttgaggaattgccacactctcttccacaatggctgaagtaatttacactcccacgaagagtgtaaattaaaaagcattcctttttctccacaaccttctcagcatctgttattttttgactttgtaataatagccattctgactggtgttagatggtatctcattgtggtttttgatttgcatttctctaatgagcagtgatgttgagcttcttttcacatgactgttggtcacatgtatgccttcttttgaaaagtgtctttttctaacttttcatctgctccttaagacctgcttttggagaaaagtgtatcagtgccagagagtgtggtaaggggtgttttccttacatgatattgttacatgtctacatgatcttgttacatgtagtaaacaagatgttcatgcctaattgaattctaggatgggcatggtggctcacgtctgtaatcccagtgctttgggagactgaggcacgtggatcacctgaggtcaggagttcgagaccagcctggccagcatggcgaaaccccatctctactaaaaatacaaaaattagctgggcatggtggctgccacctgtaatcccagctacttgggaggctgaggcagaagaattgcttgagcccaggaggcggaggtttcagtgatccaagatcatgccactgcactccagcctggatgacagagtgagactctgtctccaacaaaaaaaaaaaaagttcatgcttcattaaattttaaattctagagtttaaatgattgagggttgccttacttgcacaataatctgtccctgttattaatactaggccagtagctgggtcattattctcaccacggcaaagttaatcactcactagtaaaaagagagtgagcattaagtttatttggaggctgtttaattatcaacttttggaatgagaagtacctcttcaagtttctgagaacatattattccacttcttgccaaggcctgtcgccaaatttattattttaatttatttgtttttcccttaccatgttactaccatctctacaaccaactatgtactgaattcacccactgaccaaaccatttctgaagttactgctaacgttacccataaaaatcatcactagtttacttgaggaacaatcttttgcctgccaggaatattctgtattctgtattcctggcaggcaaaagcaagacaaacaggtttccaaggtatcaacactgcgtgcatctgcttcatagtgtaatttcatcagttgagcagatgaagaatgctaattagtttgtttatacatatgtaatttaatgagactaaacacttaactatcttaaagtaagcacaacttacttcctgttggctgtttttgctttaataaaaaacactgttcggcttatttcctggaaattatagtaccgtgcagtacaggaaaagaaattatttcaaggaaggttgactggtcaattgtattctactgcagctggattcagtaggaagataagaattaaaatattgggcttgggtaccagcgttgaaatccaatgtgaatgagagagttaagtttaatggaaagatctattataaactatattatggcaaacttctaagtccaatactaaaattctaatatataccagaataattcgttttagtaataattctatgccatcctcagacctaacctataatcttccatttcttattgtcttccttttgtttttatgtacccttttttgctagttattgtagttagattttgatataactgaaatagtggcattcagttaataaagctcttttccctgaaaattaatacaaaatagtggtactattatttgtataaatagttatttagtattatctattacactctttttgattactttgaagttgttcaaaaactggatcccagccaggcacagtggctcatgcctgtaattccagcactttgtgaagccagggcaggaggattgcttgagcccaggagttacagaccagcctgggtaacatagtgagaccttttctctactaataataatgaaaaaaactctccaagctccccaaccccaaccaaaactggacctgcgtaggctgttatttttggagaggagtgactagaggagatgaggaaataactttgctcctatagtcaaaattatattttaattaaaatgctttagttaatatactcggttttctacaaccaggggtcagcaaactactggctatgttcacagtctgcttttacaaacaaggttgtattggaacacatctgtgcccattcatttgtatatcatctctggctggcttcacactgcaatggtagggttgaatacttgcaataaagaccatgtaacctgcaaagctgacagtatctattctcaggccctttacagaaaaggttaaagcacttttaaagcttaaagctgatcattgatttgaagcttaaatcagaagagaagttattaaacaataatagaattatgttgagatgtagtaaagactaagaaacaaatatttattacattaagtcccaaaacaaatgtgggtaaaattattagatatttaggttttgtagaacctaagtaatcattccccctatagccatattacctttggaccacttcagtagtctattgaggtagaccgcttccattctgttctggcagaacaaattttctactcataaatgcataggattttcttttgtcccttcttgaagttccataaattatatatgagcatagattttgtttataactttaggtaacagagccttggcagcttcttctggcctgccagcatccataatcttcctctatacctaatgtcccatgacatcccatggggatcagatactgaatttagcttccttgtttgtcccagttcagaaaatgagttgttcattgttctaaacttattagatgacttacatgtgacaatttacaggctgttgcttatgggaacatattaagggcattgaggagcatagaaaataaaaaaaaaaaacctaattgaacttcaactctaaagattcaaatataaggctgaatcttggatgtttcagataccactagccaatgaacaggaaattatgttcctcactgaattttaatataaatttgtaaaccatattttgaagataaaaatctaagttgattaacaaagcccgattgtgtagaaactgctctaatttagtaatattagtttggagttatagaaaacacattggctttggagtcagctgaatctgcatttgaaccctagttcagtcattctctagcatttgaaatgagagaaaactacctaaacttttgagcttctcacccattggggataataatacctgtgttatgtggttgctgtgaggattaattgtaaacatagagttcccagcactgtgtcaggcacatagtacttagtacatgtggggattagcaaatatgggttcttttccactctttgtttttcttccccaagagtaggaaatagctggtagacccagttaatcaagataattagtattgttgatgaactgaattcacaacttgacagttccagtaacaaatagctaatgataaatgggttgtgaattgtgggagaatttacaaccacagcatcaacaaaaacaaaagtactgggggaaatatgctggaatggcgatgcttatgatttcagtgggaagtggggtagtctttgactcaccgcagtctagatttgtttccagagacccctgcaaatcccatggtatgttcttggggatcaggagttctgatgtttttttcattttgatgataatatttttaaattgctttaccatttaaagtgataaaatttttcttttgccataatcatcttcattgaactttttttcattgaactttttttttctaagttggtgtttcaaatctgaaaacatatacttggggatcattatacatattgttttgctttaggtatttttggaagccattggtttttactgttctgacttttcagaaaggagagcataatgagaatgtagtagtacaagcatgaataaaacataaacttagatgtggcttttgtcataaaaccgtggtgttccactcttgtgaaatcaaactggaccagatgagtgtaaaaaatggaaatcagtagttgatgctaagaacattttggaaaaatatattttattttaaaagttaaaatagtaagaggaagtattttgctaatattgtgaaattcacacatattaagtaaagatctttgccaaatgtcctgctcattttataattggcatttccagcagaatttttttaacttgagaatgacatgactattgcttttgctcacctgtctttttctgttttcatccgtgcataaagtcactcctctttctgttctgactttttgctgtccatagacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagaggtgagtgcgtgctctttagattttgaaattgtaatactttgaaattgtagaagaatgtttttccaaggaaaatttaaacacttcctttctcactttcaaggctacaataaatgtagaatattttcttgaaacacataaaaatattcttttaaagcaattgtgttcttaagttgtgttttatcttaaaatgtttatgatcttgaattcttttcaaaagaacactgcagtctgacaaactttatgattttgggcaacaggcttaatgcctctttacctcagcttccttatccctaaaatggaaataatagtagtacccaccttctacagttttaatgagttttaagtgaaaccatccatagctcttgccataacataagtgatcagtagttgttagctattatcttaaaattaaattcttcaaagaataacttattttctgctcaaattttctctcctaattttaaagagcatcatacgtcccctgccagttttcagagttgtgaaaatctcccttggccacttgctctgattctgaagttctgctcaagccagtcttgactttctcccttgggtcggagtcatgagcctgtgattgcctacacctgcgtgttattaggtctcacacttcttcatatagccctgcaagctgcatagcatagtgtcatgttgagatctagagcaccttctgtcaatccaccttgaaggaaacttctgggaagaggacacagacctaaataaatagaagagcagttgaaggtcttcatgatgtcttcctccctctgtcagtcttcatagttttatatagatttgcttaacctatgaatttggctggacattgacttaatcagacaccagctaacataatacattgataatttttaattgactcaataccaaccctctactgtgtgcaaagcaccaaagaaacatggactggctgattttcagaactgaaaggaatttaacagataatcttgtttcactcccaggaagtgctagggaagttcagtgacttgaccaaaattacacagctttcaaagggtagagcaattaattcctgctgtaaacagtccaggctggaatgactgagaaagaagaaattgaagtttgaaagatggataaattagacttagcagaaagttgagggagtttatttcagatataatattaacacaatagtactttggcagataacctttgaaatggaaatgtttaattattcttaccacactctagttgctagacagccagcattggctaggataaaggatagagccctcctcagggagttggtttgtagcacagtctgggaaacaatcggtgctctcatttcaaggacagagtgaaatgaacagaaatgaaccaaaggtgatgatgaggaagctgagattgcttctatgttttccctgaatcctgtccttactatgttggctttatcattttgtttggtaaattttgaatttctgcaatggaagtcatacacatattggactcttttttaaaaaacattatggttcacctccagcctgggcgacagagcgagactctgtctcaacaacaacaacaaaaaaattctggttcacttgatggtgccaccaaaagttccacaggcttccttcattctttttcattcattcttctttttgcccttctgactgaataacttcaaatgacctctcttgaatttgctgattctttggcttaagtctgctgttaatgctttccattgagtttttcagttcagttattctttcattccagaatttttacttggctctatttttgtggttatctctttgttgatgtttacattttgctcatgcatagttttcttattttatttagttgtctgtctgtgttttcttataacccactaaatttcattatattgaattttttgtcaggtaattcattgttcttcatttctttagggctggttactgtagatttatttatttatttatttatttggttgtatcatatttccctgatttttcgtgtcccttgtagctttgcattggtgcctgcacacttgagtatgcagtcacctctttgcttcttttcagactggttttcacaggaaaagacattcaccaattggctcagctagagattttgagagcctctcaaacattttctatggatgtgcatgttccattcctctcttttcctgctgagggagaagtttctgggtggtgtgccttctcctgatcctgaagagccatacaggctgctataaacttcccttctctttttcctaggaaaatgtactgaaagactaggatgcaataccaaattaaaattgtatataaaaaatttagtagtctatgttgtttgttcatgagtttgtaagaataagcattaagatttgactacagtgtcatgtaacagagagggcaagactataggagatggaagaggtatgtttggcattagtaactaaaactcctctccaactgagatattatcgttatggcagtaaatgttccagtgttgaatacatttgagctgtgtagtcctcaatctagatgacttcaaacatctgcttatctttgataaatacttgttatgtttttttactgattatttgttaagtttatagatttaatgcttagactgctatttagtgtcagttgtattaataatacaaaagaagatatttaaaatagcatttgacatcacaatttttgttttagataatcagaattaacttcctggttatatttttattagtgaacaggcaagtataaaaatgtattatccttagaaaatgtaacatgagagaggtcgttctcaagtaatggaatactagagctttaaaaagtcttcttgatcatctaatgcaaacttatcatttctattttaagaaatagagacacataaatttagatctcttgcttaaagcaaaagataactggagaaatggaaaactctctgcatttcattcacaacccattgctcttcataatataatattgtttgctcttttttcatgggtattgtttcccaataattctgtaagctccttcaggcatactgtcttgaaggagcttttaatggagccacagtcaaagcaaatcagaaaccacttactgaattgaaataattgaattggatatgcttacataaatgataagatcccaaatcaagtacctagtaagagtaggatttgaagagaatcacgaggtctgtagatgtgttctagaatattaggttgaaagaagaaaaagaaacagtattacaatttatcttatgaattaaaatattattggtctagaaaaacgttaagcactgtaggaaaattaaaaagccaatgaaaatagtgacttatccataaaccacaccaatgatatttttattaaaattcacattgttgacagcaatgttgcatcaaatagcagtttttcctgaagtattcatatatggtatatttgtggcaaaagtacttgttttaataatttaatcagatctattctttatgagccaaaagataattgtttagtcaagagaaacaaacttgagagcactacaaactatttgcattggggaacaagtgtcccctctgtgaatcagaaagtccacaatctacaatacttcaggttccagtgattgtacaaataagaggatctgttcccccaaaattcaaaataaaggctttcccaaatagtagggtgttttagtgatagacaactaaaagatttacaaaagactgctacacaatgtttacatatattgaactgtaaggaatgaatttggaaggaaatattggatttagttctaaaatctgaaaccaaaaattaatatatagaattgttggggtatggagcagtcctgaagtggttgattttatgttatgaggccctgaggttggctgtgtgtgacagatctcacttatagttgaatcctgcttataattttattgtggactcatattatctcagggtcaggatatatcacaggaagtacagcaccaaggtaggaaactcgatgcaccagcagcctctaccaataaatattctgcctggaaaacatgtgagttctgtctcttatgggttttgttttgaatttacaaaaattttccagaagagcaatggtataagatgaatgtcaatttccataaaagcctattcactcataatattggtcaagtatgctactaatgctttgcacggactttattcctttttttctttaggaaaataagttttgattcaaaatggaaagccaaacatacatttgctccaccaaccttagcaattggaaggggaccatttctcctcccctcttacaatgatagtgtatacgttaggaggaaaagaccagaaaaagacatttctggtggcagtaggaaggaaatgaaagacaaataaacatcttgactaaaaaggtaaaagagtatacccaatggcttaatcagagacataaagaggagtggagtatctccagtagcatggaagaggaagaagaaagcattcttcagtggcagaattggttgggttttctttctccctggcccacaaaatgttcctggtcagggcgagcatggtggctcatacttgtagtcccagctacttgggaggctgaggcaagaggatcactggagctcaggagttcttggctgtagtgaactgtgatcaccactgcactccagcctggatgacagagcaaaactctatatccaaaaaaaaaaaaaaaagaagttcctggttcaagaagcaattaatatatatataaacaaatataattgaaatagtttacattggaaacaacctaaatttgtttgtaaacaagctaagagagtaacacctctatatctggctttatcacttcacagataaaattttatagattaagccttcaagactttgaatagctggcaggtggacatcattcattcattcattcattcattcattcaataaatatgtattgaacatctcctatggataggtaccattgtaggttttggatggaggggtaagcaaaaccgacactctctgcccttttggagcttctgttgtaatggaagagacagattatgaaaaatttacaaagttggcgagcaaatgctatgaagaaaaactgagagctcaggcacaaaggcagcaacccttattttattaaagacttcttttttcatatgaatgtattttgcaggaacaaataattcatagccactcatgctttcatggatttgtatccacattgatactctgttaactggagtaactttctactgtaccaagtagatggttcttgaaatatttaaacatttcaagcaccctggctgatttacttcatgtatagtgtcactaatttaatgttaccttcctttttccttgatgagaaagatgtctaggaaatatgcccatagtttctttcttgaacatgtttctcaactgccctttgcctttacatagctcaccaagcccgactcagaatctgccctctgggtgcgtcttccaccagcttttctttcatcctgtggcagatagtatcctttctctctatatctgaacagtctgaaaaattgttccacattgtaaatttaaattctctttaattttttttcagcaattgtgttttctttcaatacatttttaaattttctttctaagctttgtatgtgtatatttaaaactaaaagcccttttcataactcatgtcattaaaacagaaccttgatctattttggtttactccagtacctcacttgactggtggaaactctacaagagatataaatagtttttaaggaaaaaggaatttcttaacttgggacagcaaaaaatttttcactttcctctggggaaactatagaaagaatcaatggttctatatatataatatatagttttatatatatctctatatatacacacatatatagtgagagggaggtacatacatagatacatatgatttttacatggaatatataaaaatggacaacactgcttatcaatgctctactttccacttatttattagagacaatcagctgttaagataaattaatagctactcaacatgtatttattaagtataaaagcttacatacaaatgtcttgcaaaataaggaaactcatgaaattctcagaaatcaataaaagaaaataaaaccataagtatttgatgaggattattagttcaaagaaaggaaatcagtgtaagccaaggtaaacccaaggctcatttcaaataaatgatcaactaactttggtgacagattagatttaagagatcaaaaaaggaagagacagagataactccagagtttgctagacaagaagatgatatgaatgtatagttaagggcagagagtcactggggcagctgggtgtggagtttgtgaaaggaacagaaatttgcttggcttggtccatgctgagattgaagtattggccgcccgtccagagggatttcctgactcagaggaagtgatgcccatggaatcctatattgcagaagacctaacactaccaaactgaaatcttctgtttgggttcacactcagctcaactattctgtggctgtcagtgagaccaccaccaaaggctaaacctgtgggccacaacacatatccaatctcagattagtctcagcacattgcttcctctccagtttgaaaaacacatagaaaatcacttccagtttccaaagtgaaaattcataacatttatcattcaagcaattgtataatgtgctttattctcgaaaataaatcttcaggatgcatttttaaatatataattccaaacaaattattatataagggaatgtttaaaacatttcttttgaactttcagtttgaacggctgaatgttgcacttcagagaacattggcaaagcacaaaataaaagaaagcaggtaagtcaaaccactttagttgtgtgaacctcttattacaatgactaatactgctactaatggccagcagttactgaatgtgtcagccctttattgaatcattgtggtatgtcagaaactggacttagtactttagctgatactaatttcaaagtaagtgcatctatttatcacattttataaatgattaaactcaggtttatatgaagtatttagaattttatagccgtttaaggaaaagacagagctggggttcgagcctgggtttttcagagccattattttaagcatgtagttataaactgctgctttaacaagctcctgtaaggccgattcttttgtactaattggtaacttctaaaatatttaacaacaggtaagtcatggatcccaaacaatcaagacttcctgcctgaaggatgctgccaaagttttgagcagggtcccagcaggtaccccatccccaacacacatctcaacaacatgttaatactttagtatctgcatcaggaggaggtagaaggatcaagtgcttaagaggagggggactcagggttccggggggtagcagctgtttattaatccttagggaagtgtttctgtattctcctaactagtttggttgcactgcagaacatcagtttgtttatactttttttctagtattctttgaaattttcctttaaagcatttctgaagaggcttaatataaagttactttttattttttattttttttttagaaacagggtctcactctgtcatccaggctgaatgcagtggtgtgatcatagctcactgctgcccagaactcctgggctcaggccatccttctgcctcagcctcccaaaaaactgagattaagggcatggacctaaagttacttttttaaaatttatttttatttttttgagacagggtcttgctctgtcgcctaggctggagtgcagtgcaatcttggctcactacaacctctgcctccctggctcaagccattttcccacatcaacctctcgagcagctgggactacaggcatgtgccaccatgctcacctaatttttgttttggtttttgttttgtagagatggggtttcaccgtgttgctcaggctggtctcaaactcatgagctcaagcattcacccgcgttggcctccaaaactgctaggattacaggcatgcgccactgcgccttgtctctaaagttacattttttaaatctgatttatttagtgaatcaaatacaatttagcacatttactgctgacagaaaatgtaataggggccaggcacggtggcaaatcccagccctttgggaggtcaaggtagacagatcacctgcggtcaggagttcgagaccagactggccaacatggcgaaaccccgtctctactaaaaacacaaaaattagccaggcatggtggcagatgcctgtaatcccagctaatcaggcaggagaatggcctgaacccaggagacagaggttgcagtgagccaagattgtgccactgcactccagcctgggcgacagagtgagactccatctcaaaaaaaaaaaaaaaaaaaagtaataggccccgtttttgattccctgaaatttcaaggtttatttggtctataaataatagaataaatactggtgttgaaatttgcagaactgaacattggagttttacaaaccagcactattgtcaggaatgttttaacaattcattcatctgtctcctactcatgagtgatcatctgctctgtggatcatatgtgcttgattttccttgctgactagctggtcccagactgcaggcagcaggaccaagccaagaaggggtcatggacaggtccagaaggaaagagtgtgaatctatgtgtctgacagaagctttgtttacacgagtaacatgagaagcattccagaacacctctgaccttaataaccagtcaagctgataagatagtcttaagtctctcactgtgctactgtgtctgtctgcttaagtccttggcagccagtttactcaaaatttattctcagggctttgtgttctgaatcgttcctacagcttcttgcaatactcagttatgatgtgtttccagcagtgtgcctcttaaaataatctcaaaacttaagccaacaataattatttttttgaaattttgaaatttttgtttaccacttccctgatgtccctaaatataaaaaaaagaaatctgattatacttttaaattttcttgatgagaactattcagttgttgaaacaagatttttgctcataagcctgcctgctgatatgttaagtggttcctctgtgcttttttagttttggggtatcctcttgtttaaagattttttacttcactttcttattggtaagtcactgccgtttttattgctgtcagtttgccaactgctgaacacaacttaactcttttttgtgctgcttattctcttctacgaattgacaaacaaaaatccaatatatcaaccaataaactgcccttgaatgaaggactagagctgcccccctcctcttttttttttttcagtgaatgagtgttagtatagccatcatgtccctcaggattggttgcccagagagttcttgcttagtttctttttctgggatcttttgatcacatcattatatgtatgaactcatgctggtgtgtgtgtgtgtgtgtgtatttgtataaggcacacatgtgttggctggtgcatgtgcaatgcttacacccacttgtattttttgaaggtgagggtaggaattgtagtttgaattgcactatgtgctgtttggacaaactaagcttcgctcatttggcaaattttgtcataatcactcatcactatcagaaatcatcacaaacaattaggcaaacatgaatcaacaagtcgtgcagttaaaactgcaaaaaaatcttatcaataaaaaagcatgctattacagtctcaatttctatgctgtaaaacaagtgcagtaattgcatgaagaataggtttctttcattactaattttttatacaaaatcaaggattaaagtttaatataatgatatctgagagataaacacagccttaaactaagaagcaaaagattctatgtatttgctttaggaaaatatataatattacttaaaagtgaattctatctgtatgtaggtttttcttggttatcagaattaccatcctcttcttggccacttcacatttgaggttgctagccagggaaggttctcctgagtacagagtctccttgacctacagtggagttacgtccagataaacccatcgtaacttgaaaacaccctaagtggaaaatgcatttaacacgcttaacctactgaatagcttagccttgcctaccttacatgtcctcagcaacttaaagtagcatagagttaggcaaaatcatctggcaacacagtgcactgtagagtaccggttgtttaccctcacaatttcatggccacatgagagctgtggctcactgccactgcccagcatcacatgagagcattgtactccatacctgtagcatgggagaaaatcaaaattcaaactttgaagtacagtttccactgaatacttacagcttttgcaccgatataaaggtaaaaaaaaaaaaaatcctaagtctgagactgtctgtattagtctatgtaaagttcactttaaaggtaaatatttcttatgaagaataacaaaacattctatgtcatatatattttggggttttccaacattgttctggatggtatatgtcattgctcctttctcataaaattgatagtcaagatttgcttctacagaaaagggaatttaaactattttctttctttctttctttcttttttttttgagacagtttccctgtgttggccaggctagagtgcagtggtggctgatctcggctcactgctacctctgccccgccaggtcccggttcaagtaattcttctgcctcagcctcccaagtagctgggattataggcacacgccaccatgcccagctaatttttgtatttttagcagagatggggtttcaccatattggccaggctgctcttgaactcctgaccttgtgatccacccacctcggcctcccaaagtgctgggattacaggcgtgagccgctgtgcctggcctaatttaaactattttctatcattgtttctgtatattataatctgaacttttagcatgtatttataagtttataacttaaaatattgaaatatttccaggaaatctttggaaagagaagactttgaaaaaacaattgcagagcaagcagttgcagcaggtaatagaattgtttatgtaattagaaagtatgccatatacctgtagaactcacattttctccaaaaatattcatatttatttgttggtgactcccagtatgaagtgttcaatattatgtattctgttaacgtaaagagtaactctttttgatactatatgtttttgtttgacctaaaacattttctctgtttatgtttacttgctgaggagtagataaggctagatgggaagctgtctcacagatattcacaggctttgatcttgaacctaactaactgttcctcatttatacatcaaaaattctactcaacaaggtaaaataaagaatgcttttaaaggttaggagcagtcatgggaaaaaagttaacagtattctcacattaatgattagtttgagagaaaaaattgatatgtgactttgtcttgctgtcctttccaaagtttcagtacatgaaccacgaggttgcatctttctaaaagtataagatattgataataataataatgactaacgtatattgaggcccccctaggagcaaggccctattctgaatataagccccacaacagtgctatgaagagggcactattctttttcccacattacagataagaaaaaatgtggtactcagagtgtaaagattaaaggagattatagaaagggaagatcatacagagcacccttgacataactaactccatctttaaaaaagactccattttgtattttgtagggcattttgccaacaaaaatagcatgttttatttaataaacaaatttaaaaaaatgaaaactacatacaacaagataaaaacacaaacacacttttccactatcagttctcaccagaggactctgtaactataaaaaattaaaccttcaacaactcaaaacggtcgtcctgacaccttcttacattcactcgtgataaaaactggacatctgccaccaaaggctctgccatctcaaagagtctttcttataagacggcctgacccaaaccaagactccttttgtcttcttcaccatacccaccctcctttgttaattctttctcctatctctttttccttttgatgttaagtgttactttgttacaaaatatttaacctataacatttatattttctatattaattaagcatactattatgtatcgtttacaatactaactgatttgtggagtgacttgagcctgtgtgcctgcagctctaagaaacaagtaaacagaaagtactaaaaaaactgcctcttggcaaggcatggtggttcacgcctataatcccagcactttaggaggccgaggtgggcagatcacctgaggtcaggagttcaagaccagcctggccaacatggtgaaaacccgtctctactaaaagtacaaaaattaggcaggcatgctcgtgtgcacctgtagtcccagctactctggaggtgaggcataagaatcacctaaacctgggaggcagagcttacagtgagccgagatcgcaccactgcactccagcctgggcgacagagcgagactctgtctcaaagaagaaaaaaaaaattgcctccttaaaaacttcatgtaactcatggcttttatgataaaaaataatattaataaaagcctaacattgtaaaaagacacagacatacagaggcttatttctaaccttatagcactcgtgaaaatgctatagaaagtaaattatatactccaagcagacattcattcagctaacactaaacaacaagaatgcgatttgattcaggaaaaaatgctttgtaatcatttctagacaaaactgagtttcatgccagtaattttaaattaacttccgtgtctgacccttttgctgctggaaaccctcatagaggaagatcctcttcatgaggatggattgcttttgttgttaacagaaagattggaggacttttgccaaaatgtacttaatactggaattcaaattattcttttgtagttaggtttcagggagataaaaagttgtgtattatactcaaccggtcattcttttttaatgaactagtttgggatttttcttcagttactagaattttagaagctaacctaggtagataatttggatataggggtttcattttggttggaaatgttattagcagatataaagggagctaaatcagcaaataacgcaagttgaaaataggaataatggcacagctttaccaaggtggcatatttgatatggcagaacatgtattatgtgatttcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggtaaggaaaacataatactatcttgaatatgaaagctatttcatatttaagagcaagaaacaaaagggtaaaaatatatgcatcacttcaaatgtttgataaaacatatgtaaaacaatggtaaaagaattgtaaagctgtaataaactgaaaacaaaattctttctgcatttgtttgcttacttgattcattactccaaaaatatttattgaatgcagtctgccttttaatatctttatggaatgttttataatgaaatttgataaatgtttatataaaaatgttttcaattatcaaatagctgacttaggttgaataataagaggtattgttttacaacaaacaaaagtcacttgtttcttgtaggaggcaactaaatggatttttaatcaacatttaatagacatgaaaaaaacaaataatttatttgattaattgttaccgaatgtggaagttaaaacatattctgtcatctcatggtagagagctttggtaattatttagtctcaggaaagaaagtttgctaactcatagttgataatacaagcaaagctaagagagaagtttcacacatgtataactttaacagaagcaccatttgttccccaaaaggaaaacagctttattattgcttttctatcataaaaataataaaatatattgagatgtttaaaaaatgagtaatattgaaaggtgtttattgtagcaaaaaaatgaaaaactaattatatacattttttgtttaaaacaaaaaaatgctattttacaactgcttttatcatgaaacagtgtattttgtgcatcctcccatgtcattagatataggtctatttggctttcttggagtcttagtggtatcccatcatatggttgtgctctattttattttatttatttagactgcgtcttgctctgtcgcccaggctggagtgcagtggcgtgttctcagctcactgcaacctccaactccggggttcaagcagttctccccgcttcagcctctcgagtagctgggattacaggcttgcaccaccacatccggctaatttttgtattttttatacagacaaagtttcgccatgttggccaggctggtcttgaactcctgaccttgggtgatccatccgcctcgttctcctaagctctactttatttaactagtaccctactgaaggatatttgggttgcttttggctttttgctgcaagaacacacatgcacatctttgtccacacatgtgcaagtaaaccttcttgtggtccaggatgatcacttgaagccccatctctctcacgacagaaaaaaaaattaagataaaaatcttacctttggaggctttttcacttccatacctgccagatggagcaagtacttatgggagaagtggggaagagaagagaaacatgctaaaagagaaggaagccaaaaaaatagaacaaagaaaaaagtaagagggagggaagaaggaagaaagaaaggacacattttcctgactaccatattatacaaaaaatagaacttcagattaatcaagtgagaccattaagaagaatatagtagcaaaagcatcagcatgctgcttagtgagaaagccttgaagcaagagcgttttgcattgttcattgtaaatcttgatttctgtgtagagtatactctaatatactcttcaaacatctgcacgcattttagaactcatagaaaataggaactataagaaagcaaattgttccttttcagcaggtttaaacacaaagggtttattactgtatctacttccccttcttttgtctcagaaagatgtgggaaacttgaataaaccacaattggttatcctttccttcataggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtaggagtggaccagggaaataattgttttaccagcaaactcactggggaacaagcactgtgcctaggacctgaattataatgcaactgaaaggccacctctgtagggtcttgcaagcccagtcctgggagcaggtatggtgcattcattatgtgggtgttttccagccagcaatagctctgaatctgcccagaaacagagataattgttctgggaggactgccacactgtcctctcaaagaatgaggagagaatggagggaggatagggtgctcaaagaatggaggatggggtgtaggacctgtgaataggagaagtttaatagtgaatctgccacttcactgtggaaaccgagttgaattattaagtgtgagataattcaaagtatggcttatacaaggaaacattatcctttgtatctgtaagagtaaagacacatgaggattataaaaattgcctttaaatagattacttcaatatagagttaacatgatacttttcatggccagttaacagaaatcaaaatcacctacttaaggcatttttgcagcttggccaagggcagagacatttgaaaaagaaagacctatcttcaaatcttgttctctgccttacttgctttgtaaactgaccaagttaaaaaacctttctcatcacttctaagacagagaaaataatattcactcacagagtttatatgcatgaataacacacattatctcccataatcttcatgaacaggattgttataaagattatgttaggtaatacatgatattcatcagtcatacaggatgagccaggcatcattgtaggcactggggatacagcagtgaccatccctgataccttttctttttaaacgtaactactattagtaagagagctaatgaagagatttcaagttctgcctgcttctttagaattaaaagtttttactgatttaaattactttgctttcttttagacattggcactaagaataaagcgtatttctcatttgtatggcttgaatcatcttctgaacttgccacataacaatctgacatttcagagctgaacccaacaggaaataaataaattattgtggaagaaacgaatattattcatgataatacataagctcttgtcttgttttattctagatgccagaagtaaaaccttacttttaaaaattcctaacaggaaagtccaaacagagccatgattcccttggggaaaaagaggtccatgtatacttacagaaaaaataattggcttcagttacgttaagtttgatggcctcttgtggaatttactatatttatttgtagccattttctatcttgagacggtctcctgtcttagaattgtgagaaggaagtctctcttccttgcaaactgctgtaattgctaacagaagtagccctcttctacttttggttatttctatcaaggatatagggtatagtttttaagtatcctgacaagcattttgaaactatgctcctcactgtaaggtataaggacaacagccacagagttccctgattaatctaactagagttgtaactagatagtaaattaccttctatgccagccctcatttctacttttttttcacttctgattttgcttgagattacttcgagatagctgaaaataaatatagaagggtttcagatacacaaaatgtataatcgtagcctaccctatgagtgccaatggctttgaaagaatagtcagcgttatttattccaagactggattatactagggctttatttaattttattttctctctgtctttcttgggtttttggccatttttctgtttctctgtgtgttcatttacccattgtttcagcgaatatgtactggttatccagcatttgccagcatgggtgcgcagtggctacagagctagagggtacaatccctgtgaggaaagttcacatatggagagggagaagagggcacaatggaccaatgccagatttccatatgacgtgacgaagggatgcagtatgcacaaagggctgcaaaagcagatatggtaggcccctaacatcaggtaggggtgggtgtaggacttcttctaattagcctatttattgagcacctgtgatggccatcatgatgagcacttcttatgtactcattgctgagaaaaagcttatgggtggcattgccacctggttcattcattactgggcacaggtaatgtaggagtcaataaactagataaactcaaagggcttacatatgattaggggaaacaaagacaataaacaaatgagtaaatttatagtatttaagtcagtataataatgtgaaagaaaaataaagtaggttaaggggaagaagaagggcagtgggtaaggggtgattgctatttcttagagggtggtaggaatcagcttttctaataaggtgaggttttagcagggactgaaggaaaggagggacaaccacgtggttatctgcagagagattgctccaggagaaaggaatagcaagtgggagcatgtttgatgtgcttaaaggataatggaaggcagtgacattggaactaagtgagcaatatggagaataagaagataaagtcagagattaggagaaagacaggtaaagaagaaatctggagccataataagggtatcagcatctactctgaggggaatttctgaagatttgtgcctcctttcttttttcctttctcaccctcatcctttcacaattgaggctttgtgtaagaataatagggtcttatagttacaataaacatttggagaagaagaaaaatgaagctcttagaattagggggttatttctggactaaaattaactatctgctttttgcagccagcatcacagacagataaaaattgcctgtaacgacaacaataatgatgatgataatgataaggttaatacttagatttttgataatagcttgatttccagtggtctttcaaacaccaccgttgtttttacctgctggttcaacatcttggtttttataattgtgattagtatccattagatatgtaattgctatgaggaccccaagggtcctttagaagaaccgtttctctttactcttatgactattaatatcttggttttacattgcacaattttactgcattgatgtgacatttattgagtagtgacttgaggcaaaatactattttatgatgaggaggatataaaacgagtaaatgatcccaacatctttaaacaatttattataattcaaaaatatattgtttctacaaaaactatcttatatggtgaaaaaaaagagatgaaatgatatgatgagtcagtgtgcaaatctgggagtagaagtcaactgttactgtgttcataggactgtactgcctctcagtgcagtgcctcaatgtaatgggtctaaaccttgcgcatttcctgaaaaagaaagccatttctgggcgtatctgattaaccctgatcctccagaaggcctgagcaatgagaattctgctatatgacttaatttcttctatccgatgtaggctgtgattcttcctgagcatttatttatagtatggaaaatatattatgtctaggtggagaccattggcgatgcctattgtgtagctgggggattacacaaagagagtgatactcatgctgttcagatagcgctgatggccctgaagatgatggagctctctgatgaagttatgtctccccatggagaacctatcaaggtaaggcagatgatatattgtccaaaagatgtcacaagagcaaatgcgtatagttgattaccaaaaccatggtgtatcagttgggggttagttgagagagagagagaaagcaaaatctatatagagaacacaatcttctctaacttgtttacattggaagaaatttattatagggtattaaatggcttacagaatcattgagaggacagaagaacccatctataagttgggctttcaaaaaatgtttcccatagtatagggattttctattgtcaaagtaaaatggcttctaaaggcaaacttcagaacaactgcattttcaaaaatctggaagctgattccaaaactatcctaccaaagccacagtcaggaaactgccatgttcagaaagctgctgcctcttcaaaaccacatctactataataatcagcaagatggcaatcctgcatcatgacttacaaaatgagtgatgggaaaatggactctctactaagcatgctatagaaaacacaaaggcttccacaattgttcttgagttatagtggagattgtgcctgccgaatctcatgcaactgtgcatctgatttaccaagcctaactgcatttagaagctgcaagttagtttagaaaatgtagttttagttttccagcccctggaggagaggatattacatttgaatggatgttgactgttaattcaccaatattttccaaggcacgtgacatttcaaaatttctagatgagccagattccagactaatatctcaccacacatgaggaaataaagttaacatggtaggcattggtttaacagatagaatataagcagattacctttgtctcacagtgaatctgccccttaatttttataggacagtcctcagttgactaccttcagaaataagcctttgaggtattgtaaaatcttatccggtatgctataaaacatatagagaagaaagaagaaatttaaaaacaaaactatatttggagatttacccttaactctctttaaccttaatagaagccatatgtttaagccttcgtaactattttctaagtctattgtcatcccatttatatgtttctgtgcaacatacttttctaaatttaatggtataaaatcacaaacttttattatgcgtggattctgtgcatcaaaaatttggataagtcatagcaggaatacctcgtctgtgctctacaatctatgggacctcagctgggaataccgaaatgggtgagggtgcctggaatagctgggattgcaacgattgaagctggaggattcattccaagactgctgcttcacttacatgtcagattccttggtggggatggctgaaaggttgggttcagctgggattgttagcgttacatgtgatgccctaatatgtattttttatgaggtggttcatgtcccactgaacaagactggtggaagctgcatgacttagtcttggaagacacaccgcaacacttccactgcactctatcagccagagcaatcacaagtctgcccagaagagagagggctcagagcccaagaatcaataggaggagtgtaaaataatttgcaagtatgttttaaaagcatcacaatatctgactttttcagatttattttcgataattgcatttttttagaggaggactatatatttctttctctttctaatttgtttgagggggcttgtagcatcaatgtaaatgttaaaaatatctagactattaacaacattttaagtgattttcacacaaatacattttataattaagatgtgtatgtttggggtgggggaatttatggcatttttgttatttgcagaaatgtatttttagatttttctaagttggaagaattatttatagctagtttcaaagatagttacctgggtaatgatagattagtttaaaagacctataaagggaatcattaatcatacctttttatgcatactaacctgcagccctgggaaatatctgacgtccctaaaagataccggtgaaacatcacagaggcagagtggagagtatttttagtagggaaactttaacatgtatcagaaaggagcatattgtgacttaacatcgtctcatttaatccttataataacactttaaagaggcatctacactggcagacacgagcagtcaagtctcctatgtgtcagtatttggagtcatgtccatgtgacttcaaagcccaggctttttctgcttcttgccctgctacctcttggtatagaattgaagtgaaagaatagaaaatattttctttttttatttttcaaactctatgctttcctttagcacgtcacatgtgcaaatcattcatctattcatttattcccattgatttcctcactaacatccatccagtcaggcttagaaagcagcaggtgggttggtgacagagaccagtgggctgagtgtaaccgtgaaagtcagtaggtgacaagtgaacacggaagcaaacttctagtacccctcctttcctaagcctagaagcttatgatgagaaatgggctatgccacaagtggtctcaaatagaagatgcccttagtaggttcccattcaaacttttcccgggagccagaattctgcctttgcctttcattatttcacagggaagtctgttaccagtgaaaagagatatgctcagggcacgatgtgtgtcttaaacacgttgtgttttaaatcttgctgatgaatttgaaaagctctgtaagaaaatgttagggttgagagattcaaaactggagaaggggaggaaggcagcacggcatggaaggactaggagggacacttgccttgtctgcatcgtttcggtttttacgagcagaatatatttacattttaattatgaaacaagataaaaatgctatggtaaatttaatatataataagctggagtaactaagtataggaagaaaaactggtttaaccagaagagtgctcacagaaagcaaaaattcctcaatctaaatatgctgaagtcatagttgatatttatgagcagaagagctttattctatctatctatctatctatctatctatctatctatctatcacttgctaaatgtgtaaattaatattctcctaaaagagacaaagccagatatataacagacatctaagttttgcttgttaaagtaaaactttgatgaagaaaggtctttaaaaataatcaaacccctgcattttataggtgaaaacatgatcggagggaagtaaagagacttaaggaagccagactaccagttactagtagagcttgttagaatacaaagttcctgattcacagtctagtgcttttgtttgaaaattttgtagaactcatatgacatcttaaaagtaaatgagtctggaaagtttctagcagatatctgaaattagttattaaaactagacataactgaattcttctgatttctaaattatatccaagttactgagttcttggtcttcattcaaaacgcatacatctaatacaactttttaaaatggttgagtaaacaaagagtttgaaaataattaacatggtatcatcatcatttaaaatatctccactttagcttgttttgtagtagcagtaatttaagtgtttgtgaatcttttaagatcatcaagtaatcagacctttgaagattccattgttaaatatcctgctttggctaggcaaggtgacttacatttgtaatcctagcactttgggaagttgaggcaggaggatcacttgagcccaagagtttgagaatcagctgggcaacatagcaagaccttgtctctacaaaaaatttaaaacttatccaggtgtgatggtgcatgcctgtagttctagctactcaggaggctgagatgggaggatcatttgggcccaggggttcgaggttacagtgaactatgatggtaccgctgcactacagcctgagtgacagagcaagactctgtctctaaaaaataaataaaataaaacattctgtctcagtggctttccaaatcattggagacttccagaattcctaaaattttgccacaacacatcccagactgcctcttatatctaggcatggcacaaatctgatctttcatcagtatggatttttaatttcatgtatatagacattgtcatcgtcattggactcaagtaccttccactttctgcttcctctgtcattttctgcttaaatattacaatttcatttcctcagttgtaagtcattagaacagtgggatagtgtttggtataaagctattttgaggtaaaatgtctaaaagatatatttaatatccttagagctagcttcatttgcccttctttgtcagtgtttgggaaaatgattccaggagtccagaaattatgtctatctcacttgaatgagaggtggcagtttcacataaacagctcatatcccccttgctatgttgctgtggttactatgatccctgtgcatggaaacttgtttcagatgttgaagacagacacaattaagatggtttgtgtaataaacctaaatggaaaagagttaagaagtgtgactgttgattctgcactagtaatttttaattgcatgtgaggagtagagggaagttggctgaaggttttgaggaaaggggtggtgtcctgagggtgaatggtaaaataatttagacggtattcaaacgacactgacgagtaggaagtgttttaccagtgactgggaacatcatgttattttttgctttcagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacaggtagtaattatgttaaacacctaaaatctcttgtttttatttatatacaattgccatttgccccactgatttgattcattcttcataacttttttcttccttagtcgtaaggaaaaaagaaacgtgataacttttatcatcctcactttaacttttttacactgcttattagcctcctaagaatgacttgcctgaggtgtttgtggcccagccataaatccatgacagatattacatagtcttccatcattcttcttttagaagcacatattaatactcttagtatgttgataggtgttctgacatcaactagtacactgcagtgcagttctggcagtaaacacccagactcagcacagtcataaccacaagttacagggcacagaacccaacaagcctgcccttaattcagatgccagccacccttcaggacctaagtatgcatttagacgactgagctacaattttgggggttcccatgaacctctcaagttagataattatctaaaatgactcacaatacttagggaattgctatacttactattacagttttatttcgaaggatacaaatcagaaccaaccaaatgaagaaacagtttgggtaaggtttgggagggtcccaaatgcagagcttccatagaatcagaacttatctccctccagccacctcagtgggttcacaagccaggaagctccacctgattgagctttgagtttggtgtatggagtcttattgttttcattatgtaggcatgattcgttgaatcattggccatgtgattgaactcagtcaccacccccactctcctccccagaggttaggctaacacaaaaccccaaccttctatccacaagattgatttttctggggccctgcccccattctgagtcatctcattaatataaactcaaaagtgatccaagggcctcatggaaaacagatactcctataactcaaaaaatccaagagttttagaagctccctccctgcaatcaaggacaacagccagtcaaattccctatcatacagggaagaatttaccagaggaaaactagctggtcatcgagcacttttcaaagattgcagttttatggactggcagcaagtgttaacacggtcagaggagccacgtgtcatctagcatcagaagaacctttattttcactgtcgccttgacaacatgtagtatacagcctgagtcaataaaatctaccattttgttatcacttatccacctttaaccggaaaataaaccaatccgtggtaactagaaatatatctttcatgtacattttgtctcattatattggaaactcttaagtaacaaaagagtttttcagatctatacagtagctaaattatactaagcaagttagctttcctattctcagagataactctttaatagcatcttctcccttcttcttctgcatttatttatttatttatttatttatttatttatttatttatttatattttttgagactaagtcttgctctatggcccaggttggagtacagcagctcagtcttgcctcactgcaagctctgcctcccagtttcaagtgattctcctgcctcagcctcccaagtaggtgggattacaggcgcccgcctccacgtctggctaatttttgtatttttagtagatactgggttttgccgtgttggccaggctggtctcgaactcctgacctcaagtgatctgcccaccttggcctcccaaagtgtaggattacaggcgtgagccaatgcacctggtcttctcccttcttaaggcaccagcatcctttcctttccagcccagactctcagttgataatcttgcctcatatttcaccaccagaatagaagtcagacaggagctttgccatctttgtgctgtaggttctctcagcagagctaccccagtactcatctcctccttctttgttcccattacattggcccagctcccctcctgcccctggttgatacagttttactctcagtgctatttcctctcaccttctcaataacttttctgtggaaattaactctctatgatcaatttctctttgatgaaatgattattcccaacagaatacaaccatatctattaaagctctgaattgaaaaataaaaaattccttgtttccaagtccggcttctgctacaattttcaatttctgctctgttttatagcaaaactgaaagaagttgtctatactcactatctgtattttttccacctcttattttctcttcaactcactccagtcagtgtttactccactcaaacggttcttatcaaggtcatcattgtgccctgctaaaataaaatcactgtcagttttctctccttatcctctcagaagcatttgaataggctgagaactccctcatttaaacattttcttctttaaatttttggcaccacattcacctagttttctcactaccccatgtctacaccttctcagtgtcttctcttggtactccttccctaccaaacctttgttgccgtgctcagagcctcttttcctgttatcttctgtatctgaacttttatgactctaactattttttaaaaaaaatctttcgcccatcctgtgattctctgcagagctacagactcatatatcctattccatatttccacttggatgactaattcacatattaaaatgaactggaccgaattagaatgagtgatttcccacacagactgatgaaatccacttcccacccaggcaagcttaccaatcaccttaaaatgatatcaccatccacctagttactcagaccatcgaccttacagtgatcatttcttctcctctctttaaagagacactccttaactatcataactatagcaacaaccttctcctcacataccctctcattatcctatttcatcttctcagttcacacctgtatctgaaattgtcttatgcagtatttatttatgtgttgattgcctgcctccctttttagaatgttagcttcctgtggtacacattccatattcccagctcctagatcagcgcgtgaaacacagaaggaaagcaagaagtatttactggttaactgttgactcctgggtatgaaaacaactcagtataacctgagaattggaaaaatccctggggttcattgtaatggtaattggcctatggtcctactgggtataataggtagggataagaatccatgccttgagataatatgattctactctctctgtaggcattaagaggaatcatcctattaagtaggagtcagttgcccatcctttcactgacacctgtgtttctctttcaatgttaagtgatgtgttatgtgtatatgtgcatactgaggaatcctaccttaaaacaaaactgctacatataaaaagcatattttcctttttcttctatattgattgtttttaacagtatgaaactaaactttttaaattcttgcattttgtatctcaaagtctggtggtcttgagtcatgttagggggcactgatattagctacttatttttcttcaaaatataattcaggatctcatgtatttcagcagaggaccacaacatgttgacatatatttctgacaacaggacaatgctcatgacttaagtcttagattcactgtattggcaatgttactagaaatgcacatataggtttttatagcatagatggtgttatcttttaaataaattttttattactgtggtaacacatgcccatttcagaaaatttacaaaattagtaaattataaagtaagtaataggaataagtcataatctcattacccagagatagtaactattaacatttctgtctttgtttcagttacgtttatatacacatgcatgaatgacattgaaattttaatttaatttatattgaacttcagctcatttgctgaagtcatttctactttttatagacaaatatgatatagcttttttccttttgtattgatttcaataatagtttactttctttttattctcgtatatgagatatttatgccttgcctaagggaaagcagtagttaatactgtcttatttaggcaaaatataaatacttaatgttaaatacttttaacaacattttaaattcctttctttcagagatacttcacttttcttccatatgctgggaaaacttaaaataatataaataaatttcaattaaacatccaatgctttgggaaatttagtcaacggtaggggcataattttagttttactcaaactatagtacaagaagcggctgctaaagaaggtgtacaagcacaaaatgcagttttctttggagagctttattgatgatacattaaattctggaatgatatttctttaataataaaataatctgtttaatattgaatgtagcttccatgatatatttctgaaatacaggtaaatttaggacacagaatacatacctataccaaaaaaaaacctgtatcttcaaatttccacttccaaattctaatcagtgattcagaatgtagcagtgtaatgacagttatacactcctgttttttaaacattgtcaggagttttactttaattttaggggataatattcgacattttgtttgcattcttgaagtaaggaaaactaatagagactagtagagactacattagatcagtgagtcagtggatccaggtctactacattagttccaggtcagtgggtcaatgttagaggattatgtggtgatccagggatcattagaaacaaaaatggcaagtggggaggatacatggatgctgtccagtttgtggggtaaacaggcctagaatctcttatttgtaggacaagtctgagcacattgtgctagagaagcaagaattgacttctgtaagaagaaggaacaaagtgaataaaggaatataggaaagataacagagaattggagcattgatgcagtaatttgcggaaaaatggtgtctggtgaagaaggtgtagagaaaaatgtccacctatgaggacatctgggctgttgctgccttttttgggtgttgctatcatcaagctttcatcgaaatggtttgtttttctaaatggtttttcttatatattctgattttttaaaaagacaatataatgaacatttcaaactccatagcattctaattatgtttgtctgttaagtgtctttaaaaagcatagaagttgtattcagaagacatgccttagagtcccacaaacagcacttaccagacgtgcaatctagagcaatgcccttaataaattcaaatgatgcactttaaagccacttctaaaggctgaatatatgtatataatacatttaaataggagattataattgtcattaccgtatttagtaggaaatgttgagttgctgtagatagaaaaaataatagataaatttttttaatcacctatagttttatacatttttatttattagactcttatagttgcatacatttttgtatttaatttttaaacatataaaaaaacaaagcaaacaagatgacactcatgtagccaatactaatatttaagtatcaacattttgccatatttctttcaggtttctgttttataaaaaaataaaatgtaaagtaaatagatattaatataataaaatataaatagaaactcttacatggtccctgttacacgctctgacacaatggatcctaagtgctttatagcttgtaggagctgagaatatgtactctctgcagacagtctcccaaatacagatgcatgttcagcagcttctccacaactcatcaataagatgtcacttctgctttccaggaaggaaaatgggtagagagaggcaggaatatcactttcatttaggtcctgccagatagaaaaataaagccagaggaaaatagattcccagtgaacatatccatatccttttaagacttgccttgaatccactcagtattatgtttctgagatagtttccttgataaaatgtaaatctagtcataaatctagattattcattttaactattgctaatggagtggtttgctggtaaaccagctttggaggatgaggtagagaatccatgattccagcatttgccaatttctgtggtgttactatgtccactctggcaggtttcaggctatggatggcttaactgtcttacaaagttcctgaattttaacaattggctctcacaagccagtatgaaccagatctagcatgttactatatgtgcatgtgatataatgtgtattctagagtatgaatgagccagactctatcttctacctgtgggtaattagagtgtgtccaatttttcattattacaaaaagtgattcaataggtatctttatacatatgtctttagataatataactaaaaatggtattcccagaccataggctatacccagtttcaactttaccaagcattaattagctgttcaaaatgattttaccaatctatgctccaccagtagtgtatgaagtgtgctattctccaaggtgatattgtcagacttactgttaccaatatgataggtgtggtgtgatttctaattgatgcttagtcagtttttaaaaattgatttattcaattttcacaactgtcctaaggaatatgtactattattatccccattttaaaggctggataatggacatctgtgctgctagagctatcagactttgaagcttatacttttaatactgtctaattctataccttttcattatgtattctcaaataatagtcactcaaaaatatttataaattcatgactaaggcatcattttcattagttttattgtttagcagattacatatttattgatgtactgatgaaaattaaactgtcattcttgagacagatttctattcagttggtttcttcaatacatagatgttgtcacagtaccaaaatctaattcaacatcatcattctatttaatgtagacatgacattacagactagtgagtagaagaccatggtctgtttgggtaaatataataaatgcttttctgtagaaattggttgagaacccacagccatgcaacatttttcatctatggcctgaatattaggttagagagaaggcttattaagttctcatttgatggaaagctagggaagcaaatggaaagagatgccaatagcttaatcagtaagattagaatttgaaataggtttagcataatgaacaagtagtaaaatagcaaacaatataatgtggtaaacagatgaatttcaggagaaaaaatattgctaataacaattagtaagtagagtggtgatatgtacaattaaatctcatttgagtcctactaatctagaattcataaaaattctattgaaagattcaaaagttgttctcacatcatttttgtcattgtaattttggttcactatttcttgcccatgattacgttttatgcccacaattagcataatatttacaaaattaatgaattgataaatggacatcttacctctttcaactcaggaaatcttaatactgttatggttatgtgtgaatactttgctactattaaatctttggattattttttcactactgcaaattgcactgttgtgtggatattatttttgcaaaaatattttataattttttccagtgtaagtgaaatacattaattgacacaattttcttgttgtgaattgattcttcattgtacttctgggaagatgtctgttaatctcgttagactttttctgtcactcacacctaaaatcactggtttataaatattctcagtaacattcagttagttatgttgtgttctttttttgagtggacaaacatttatgtcagtattatattttaatattttcagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaacatattttcacagtgaagttaaatcatctgtgataggttccccagaccagcctacaaaggcccattaaatacagaataatttgtggatcttcaaagaggatgaacatacatttccatgacagagtccatacgaaattcacaatttagatgctaaaaaatttaaggaatatctttttttctctatcttatctgctttgaagcatagcgattagcgagaaacttttcagatccagaccactgatggtagccagagtagagaccctggagcatagattcttaaaataaataaggggcccaagtcagagctttgaggtattgaagatggaaaaatagtggacaaacagcctgtaatcaggttggggattacgggtactgagttatgttgccatttaactattctaaaaaataagactgggtctcaagactgcttccctaacagactgtttctcctgaaaatgcaggagctattctttctgttctggttatatagtttccattcatggcttcttgtcctgttgttttttgtgtcgagtacactatataaattatctccttatacatatttctcaggcaagcacagagttatactgaacttttctaaagatgctttgcatcaagaagcaaagggaaatacagaattaaaatgtttctttccattttgctttgtttttctatatcgatctagactttgtaggaaaatgcaaagcgtatatttaagaaaacctaaataagaatagattcatttactcattttcatttattcattcatgaagaatttattgaatgcctactatgtgccaggaatattgctatatttttgaaatttaaggataaaatatggcccaatctatcaagaaaggaaagtgaaagacaaatgtaagacataattacaacattctgtgggagcacaaagtaggggactcagttcttagagaagtcttttggtcttagagttcatcaagcagagaaggggaaggacatggtccaggaaaataaatcagcacacaaagagatggggtcttgagggtgcatagtacattctggacagccagttacctgggatgagttgggagggaggagaataaggacaaaagaccatctgggcaaaaatcacgaaggggtatgtgtgtcatgtaaaggtgtgccatgatagttattcatattgctattgtaatattaatatatagtaattaactacacatgacacagctttacatgaccttaagtagttatcaacattaccataatagtaatattaataactacaataagagccattattattcacttgaggcacttgttcaaaatagattttacaaaagaaaaaaaaaaaagaagcaacatgagtaaaattagatccattggctactgactccctctccaacagttttaaagctactagataagagaagcatcaagtcttaaaggaagagaatggtatgatcagatgtgtgttttccaaagactattagaaacagcatggttaaggatagggtggatatttacttgcacaggtgactgaatgaacatctgtttatacatcaagggaaaatgattcattttatatcctggatattttaccataagtatgagcataaagctgggatgtctggcattggaattttatgtcactctcaaggctaattagtctttcagatcctttggtagggaggaaagaagagttgcttcagcattttgactaacatttcttccaaatttcttctccctgatatttccagccacgccaaggcaaagacttcccagctctgtctcaggttaggttaaaagaaggcataggatggaagagggtggtctgtggtaggcctagcaaatgaaagagatgaataaacaagagtgtctagtctaactagtgcctgaggaatagacatcagtcctctgagattacccagctggaaaactgcccagatggagctttacatgcaaagctccagtgaagtctagtgctgtataatgctttaaatccacaatcaagcccttgttgatgcaaatgttagtcgcccaaagcagaatgggttaacgaattactgcagtggttttaggtgcatgggtttgacccatgtaaatcattttaataagtaaaattgaatctttgatacatatttgttgaggagcttgtcagatcactacctttcactgaacagtaaaacatggatcatttatttcacctcattttgcacttcaatgcaatttcactctttaggtggttgtacttggacagttaaatgaagactgtctttaagggtgcagggatggagaacacagcatatatgagaggtgggagggcagagacgccttgcgattcctgtgaggagggacttaccgtctcctccaaaacagaaattcagtgctgcagagacggtagcaaagtgcagttctcttgttaaaacacaggctaaaagcagtgactgcttaacttattaagcagagaaaaccaaaatgtcattttcaaccaaaattgagtgttagagtttatggtctctgttatgatacttttcaagacctgggaaatatttgtatcctttagtgaaaaggggaagaatcaattactgaaagccataagcttacagtaacggagccaattaatcctttgtcatctttgttgagtttagttttcttctgttcttagcacgtcagctagtagatctttgatgaactgttgctcctctttaaatgtttcttttattatattgatgatgtgcactcattcagtattcttattttaagctgcagtaatcactgtacatttgattgccatctgtacttcccttgaagcagctttgcttattacagccacacctgcatctgttttgactagcccacataacctacacatttttcatccaaagctatcccattaccttatttatgtccatttattttcatatatagtatctgccaaaatagtagcaaaagttttatcaatgtgtagatttcaatcagaaaaacctaagcaaaaggaaaaaaaagtgatattctaaaagccacacttcttttatcaccagtgcagttttttccatcatcataaacttagttttatgaaaatgttaatatcttggatttaaacattggggtagaaatcaggacaaaatttaaatgtcatatccaggacttaatctcagatattctggtagaagatatttagataaggttgtggctgcctgtcaagttttttaattttttaaattatataatgtcagaaaattaaatcacaaatgagccttccagattgtgaggaaaattacttggctgaaaatgactttgcataatgcccaaatcttgaagtatctgctcagatgtttgttccatctgaaatgctgccaaatccatctgtattgaggaaagagctatgaggtagtttcagagaaagtgaaaacaaaacaaagcaaaacaaaaatgctattacagaagttggacagcccaatgtgttaagtattatacacctggaacaagagcagcaaaactgaagctctttggaaagttatggcaacagtggtctgggaattctgggcctttagaaataatcattcccagtgatacagggatgtgcagcatccagacactgcttaatcacagtgagctgccgtcttccctgaataagttgtatcttataacattgaagtgaatgaaaatgtattagtatttgagaatttactattccttcacctccttgcacatgtaaattaaagatgttttggaaaatatgagaacttgatgttcactgccctagagcactattctccaaccttttagattcctgcaatctgttaataaaatattgtaggacaacaactctatagactgatacatgctgctctcaatccatatactacatattaggacagcttttcttttctaaatgagcatgaatataaatagaaattctagtattttcttcacctaccccagtgaatcatctttatattttacttgggaaactgctacagttggctagtgggtcttcacttttattgctttgagaaatggataaaagacatagactatcacccctccaaaaatgtgcatatggccccatacaagacacatgtactgccagagcttggggaactccctagaatctactcctagaccaccctagtgaagtaccatagaccatattgtctagatgggacaaaataataaattttgactaagaacttactgtttagagagaaaaaatagtaaataatgttcaaaatgagaagacaataactgacaagtctgtgatttttgggttagatgagaccacttttgatttttgaggaataaaaggagttagttttttggtcctgatgtgtaaaatgattcatggggtttcacatacagacaagtagttttcttttcagcaaatatttaacatatctctcaatatatttttcaccagtttttggtaaatatgcattgctataggtataccaagttttttttgttatgtttagtaactaatttcattttttctgtatatgtaaatatagctattggaccctgcattgaaaaccttcttagtactaacaacactccttttattattaccttcatagttactttaaatgacatatttatttcgagttttacttctggctgagttgcaaagtctatgagaatgttacctcctgtctcagaagcttgttagttattgtgccacctaaatattgtaataaaagtgtttaaataaaaatcttcttaaaatttaaaatga

SEQ ID NO: 116 - DNA, 71647 bp, Homo sapiens
gtgactgaggacccaacagtgtgctccttgcttggaggctagtgatgagctcctaatttcactgtggactgcccagatttctacaagacaggcttctggagacgctgtggattctctcctgagtgactaggggctggcaggaagggcgggcgcttggtgctgcatctcaatccctgtggccccaggagcagctgcggcaggaacatggtgagcagctctcagcacccttggccctgactttccttccgcttctgtttgttgagcacctattgttcaaaatgcctgttatctaagaggctacagtttcctgagcgcttactatgtgccaagtacctcacacgtattacctcatttaatgcttactaaaaccctatgaggaagggaccattctcacccccattttccaaatgagacaactgagggtgagtaagatctggcttgagtcaaacagcaaataagacttggggtcagcaatgagccctcatggtctaacttcagaaccgttactctataaccccaacaaccatcctccaacacagcaaacggtattatgtccactttagctcatgagcagactgggctcagagaggttaggcaatttacccaaagctgcacagctacaagtcacagaaacagaaacccttctggctccagagcccaaaccctttctcctaagctgtactccctctctgggcttactgagactgcattttattttgaagccacattccccagccaatgcctggcaggcacggtgagtaggactggatatggaatgtgaaaacatctttacaggagaaagatttggctaaaccttaacattttcagacattttaattgcttctttggaacgcagatgtttttgggggtgctgcagccatggcccaagtagcctctgaaagatttgggtgtcaccagcaaatgagagtccctgcctgcttgctgatctcactggttgagcagcactagttccagatggttagagaactttggtgctggcttgccattcttacttatttcagtgaggccctcaaatgtgtagggagtgtgtcctaccaagtatccccctccacctgggtgtgggcagcaaacaccaaggtccccgcatatgctcgacacatcgtgtgggatacattgcctcttttgctctctccaggggcagagaaagtcacctgatttcagtggacaggaaagggacatgtttataatcagtagagggtgagggggccactctctgatctataagctcaaggtctctaaatgattaactctggtaccagcttggggaactgctgaacaccaaagacaaatgctggaccacatgactcaatggccctaaattcatcaaacagaggcacactatcggggtggtcatgacctagaagtaggtgatgtggttatcaactagcagcagacttcaaattccccactgcctcagtttcccttgttacacactagaagtttgtctctagtgctcgggcagtgggcatgatgttttatttgattgggcatacttttgcaaagattgctaagttgaacaattgctatctttgtttacattggattgatgttgaataacgggttatttaaagattttcatgagacttgaggcttcatttcagtacttccttgctcgataagtgtttgttaaatacctcctgtgtagcagacagtgtcttggcactttagtcaaaatatagataaatgacacttacttcctgaccctgaggagcttgcaatttaacaaaggacaggaaaaaaatatatatatacatacacacatatgcatttatatgtgtacatggccacatataaacatacataatatatataagtatatacaaatacatgcacacccatacatacatgcctgtgtgtatatatatatgtgtgtgttgacagatacaaaacccgagcgtgtgcatgtgatagttaacacaccatctctgtggtgttgaggacacagaggcatccagcagtgagcctgacagggaatgatggctgggtctggcagagggagaggaaatggttctgcagaccaggcagtatcccagtagcctcagagcctggccttgccctgggctgactgggtgagaaaggaggaaactctatccattgaagaaatgacatctctgtttggggaagggtggtaggcattttggatgagcctaaggcagcaggagtaggtgataaaatgaaacaaattaagacagttctagagagtgctctgaatgccaggctagggtgcgggcacatattggggagcgtagaggcgggacaagatggagtaaggagtaaggatgacattggtggtggggaactggaaatatagcccagtaggacaaatatttccatttctggaaaataactaccagagtttagacactcgccttcctgttggcactgggctctttcactttaagaaattcctatatatatgaaaatccaaacttataaaataaatctggagcctgatatttgtgtgacaaaagaattcttcccttcaggaagaaatattttgaaagctgagctcacacagtgctttcaaacataactcaatcaccctgcttgtgttaggagccccgagttgcggaaggcaggtggcctgcctggggcacactatccctcactaagcagaagtgttcatgggtcctccttttttttttctctgatggaggaagaagaaagagcacagattaatgagcaaacccagaagacagttctttctgttaacctggtgctgtctttcttattggagtttcctcctctgttttcctgcactcgttatattctccacacacacacccaggtatagattcatttttataaagaaaaaaaaaatcatcctgtcactgcctttttggaatcgacatgaagtgtgtgcccttcctttctgccaggtctaaacacctccatgccactggtgtgtttttgaattctttgttctaacaaaccagttccttatttcggagaggattataattgacagtaaatactttctttaactttctctaattacaatttgatttcaaatgtagttcatatgttttctatatagaaataacccaagcggtggggtgccaggtttttcctaagttgggaatgagcagagctattaaattaaatcacgagaaacaaggaaaaggtataattagtttctccaagaggatgccattgcacatttcctaaaagacatgaagatgtgtatgactggggatttcatgcctcataatatatatttttcttctggttttgtattctagtatggatttatcaacacctgtctgcaatctcttgtgatagagaaatttggtgaagaaacatgggaaaaattgaagtaagtatgtgaaagggaagatgaagtatctctggagcaactggtaagcctccagtgttttaaaggttacagctttttactgaccttttgattaagccagttagttgaatgaacccatcataaaagatacagctggttctcaaagagattcatttactagggagaccaattcccgtaccgtaaacatatgaattagatacaggaaacacctggtacaccttatctgtcttcgatgaaggtatcagtcttgattaccaaaatcagccttaaatgggatctcactgtaaataataccaacattattttaacttttatctcatgaatgaattctcattttctctttctaatcacagaagagagagcaactgcattatttccattgcacatcaagggagctgccaaacagaagaggggagataccttttaagtttgaccagaatcacttcttaggtgttctttggttaattcttagtttttctcctctgcctctgtccagtaaccccttaatgtcatcatttatatctccatatagtctcctgtctgactcttgcaatcttgtgctatctgtctgcttccctagaggctcccagacctaaagtgttagaagctggggatgaaagtgcctcagaaatcacttgatcctaggaagggagaggaaaacaaaaatatggaaaaatgattggcttcctcagttcatcaatgccatgcaaattaaaacaattaggcactgctttgcctattaaatctccaaaaaatttaaatgataataaccagttctggttaagatgcagcaaaatgggtaatcgctgatggcatagtaaatcagtgcagcccctttggaaagcaatctgacaacatgtaccaaaagctgtgcaaatgatcaaatcctttgaagcagtaagtccattcccgagaatctattctcttagaaatgcacacctttgtgcacacatatatgcatatatatgcaaaaagatataatgtagctttatattgataaataataaaataaaaattgtctttagtagttaaaaacaaaccaacaaacacatagaatgacaaaagaaatatgcatcatgatatagtgattgcaaagatcatgaagcaacttgcaaatttttatgacaatactgttaaaaaaaataagaaaaaaaccaaaaaagacacaagttacatatctactaggtaaattacacaaatgaaaaagggttaagagaaagaccaaaataataactaatagtgactgaattagataaaatgctggatgattttttttcctaacatctatttcccaaatttgctatgtttttattgcttttgtaatgtaaaaacaacttaaaatgcttaatgcaaactttccctcctcttcctcctacccccattttaaaaataaaataaatcgagctgagagcacagtgacttgccacaggtaggtcctgcccagacccatggccctgcacaggcctggtcactgcagcccactgctcacacacaggacaccatcaaccatcttattctcgggaaggcagcccaggggtaaatcagcatctctggggtaaattgcttacagctccacaagtttagatgggaaaaaggagctctggcctcatagaggcgaagaatattcatttccaaatattttaagtaggagcactgagtaactatgatcagggaaaccttggactcgtggacccttgagagattatttagcccagatcttcacagttgacaggtgaggaaactgaggcctagaaaggttaagtgacttggccaagactgcacagcaagggagcaacagggccaggatgcgctgtcagaaccttaaagtgctccttttcagccccctatgcggccgtgggaagagaagcatctgaagactttttcatttttttattttttgtaacagccattgcgttgtaaaggctaaactcagtaagaatagaggacaggaaagagcagtcttcttattttaagcacttactttcggccatgcctcttatataatggtcttttgaaagcccaacaagaacactgcaaggcaaggtattgccctgcttcaccaaagaggaaacagtcccggagaggatgatgctgaagactgcacagtgcataagggggctggggtggggacacaaatccaggtcggtaactgcaaagactcctttctattaggccattctacctggggaaaggaagagcaactggcaacgggaattcattttcttttttttttttcttttttggtgagacggagtctcactctgtcacccaggctggagtgcagtagcgtgatctcggctcactgcaacctccgcctcccaggttcaaatgattgttctgcctcagcctccccagcagctgggactataggcacccgccaccacgtgggaattcattttcaggggctctgggtgaaataagagaggtgtgtctttaaacatgtgtttactgagctcccatagtaggcctggtactatgaaaaacactggaggattgaagaagcaaataagccttttggcctggatggctttagaatctgtggaaacattacaggtatgcctggaacacaggaactagggtgctgaagggccatgtcagatgggaaactgggatcgtttcctctgctacaaacttgacaggggcaggtcagctccagccatgcacacctgggccttccagaggatcagctgctcctatgcagagggcaaggcgtcttaggaggaggaaggagagatggcaggctcagccaagctgttgggtggacactgcatggtggggtggggaaccaacttgggaaataggatactcatattctcagaaacacggcattgttgcaagtccttaggaagcagtcgttggattcagcgggggctctggggctacaatgctgaactcaaagcccagaagcaaggcctacagtctgtatgaccctggcatggcacttaaccactctgcgactcaggtatttcatctgaaaagaaaaataataaaagcagctaacctcatggggttattgcaagtgttaactgagattgatgatacaaaccaggcacttagaaaaaatgagtggcccaggatgagcactcaacaaatgcaagctgctgttgcataatggctgcttcagtgcttggtattggcttattttcaagatgctcgtcctcacgtgggttgggggagaggtggggggcagtggcgtgcgtcccactggactggatttgcatctgggctctgctgctcagagctgtgtgatcttgagcgggttgcttcacctctctgaagctctgtttcctcattgataaagggggaataatgtacctatcttctagggttaaggagagaattgagtggtgcaatctacacagaagtgcctagtagaaactcagtaagcatccttcctcctctctgagatataggtgctacattaagattacattatacttgacattattagaaccactttgctgctggtcagataatgatgctttccatcttgaagaagcagatattcctcaaaggctttctctttgcccagaggagaccttgcctcctaaagttagtgtgatttgctgaatggctttatctccactcctcatttcagtctgatctccctgacgcctagtgtgggccactgtctagccctgccttgaggaaccctcataaatgctagggaccaggccgtgaaggggagagatggatttttgttgattgatttttgacttacgaattttctaccatgtgatttcctggttaggacatttagcctcagctcagctgctgcttagaagaacctgtcctgcctaggagaaaggccagggctctggaaatcattgaaaatagccagaaatagccagagcacttagacatgagcagaggtaaaatgacatgttcagctctgcctacgacaggcagctgagatgtgttgtttaaggagggactctcaccctccgggtatgactgaacacagatagcatggccagctgctggaaccttcattggttgagatattcagcatatctttccaaatcaagggggaaaaaatctccagctttccatgtgtaagtggatggaagagactttttcctttttggatccttggtgcgacctctctgaaaggctggaatgtcatctctttcttcctttagaagagcagttctcatagcattcccaaacaaacaggaatccacatgacctccagggggataaaggacatttgaatgagggtacaagaatgcaagggaaccagagaaatatgtctgggaatagagaacccagcagggtacatcctgcgcttgtgtcattaggttttatctctttcatcttgaagtttcaattatctgcttaactgggtctcaggatgtttgtatacagagcactagacatctatacgattgcattggaaatgcatctttaagccaaaaataaagccaatctaagaagtccaccagctatgaaaattgcatcatattagaatttactaaaaagaaaaaagaaaaaaaaactagtgcagaaaactcagcttttaaaggagaaattaaggtgagattattggctgtgcaaaaggatttgcttaggccacatttaaataacaaattccctaatgcttttagagtagaatttcagctgagaaagaaaaaacccatcaattcctacagaaattttaagaagaaatgattaggtaaaatgaagcatgtttccagaccttatgacataaattttatcttaacatgaaataggaaacagatgtttctcctcctttgcttgcagtattttcctctcttatagtctagatttgtagatttctaattataaatcactctttttttttttttttttaagagacagggtctcactctgtcactcaggctggagtacagtggtacgatcatagctcactgcagtctcaaacccttgagcttaagtgatccttccacctcagccaccagagtagctgggactacaggaatgcaccaccatgtccagctaatttaaaaaaaaaatttttttttttagagacaaaatctctctatgttgcccagtctgtttgtgaactcctggcctcaagagatcctcctgcctcagcctcccaaagtgctgggattacaggtgtgaaccaccgtgcctggcctaaattgcttgtttataatcttttggttaaaacctttattgaaatttaacaatgagaaggaactaatggattaggaagagtaaggcctttggaatcagataaacctttacattttgcctggatcacttacttgctgtttgacttgggcaaatgtatttattcaacaagtatttagcttctagaatgtgctgaacaaagtttcaggcactgggaatagaggcaaaaggaataggcaagtgctgtgttccctgggaatgtattccaatggggaggacagtaaacaggcaaataaacaaataaatctcaggttgtgcaaagagctaaatttagagtatttagtggtgactgggcagagaagatgccagttgccctgagctggttagagaaaacctcttggcaaaggtaatgtttgaactgaaaggaaggaaggagtcagcctcaagacagagaagttatatgtgttccagagaaaatggcaagtgcaaaggtcctgaggtcagactgaactcagtgaagaaaaaaatctaacatgcttggaatatcatatgtgaggagtctgataggagatgaaggtggagagggttttagggatcaggacatataaatgtgtagaagatgagaaggagctgaacttttcttctaatgacaatgggttactgaagtttctgagctttggtgtggtcacttgtgaatggagataatcatggtgctcacctcatccacttgtgagcataggtgaggtggctaacatccccttggcactttgtttgcagaacttagtccaggattttacttccaaggatcagcaatccactatgtaagctaatgtttaaaggagttactataaagattcagaagactctaacagaactcaattgcaggaagtacagataaatctcagaggaaacagaaagtcagcaggtctgtttccaactctgcatctcccttcacgtttactctattttcctggttatctcttctctctgaaagtcttttgatttctgttccttttttttttttctgtcacccaggctggagtgcagtggcatgttcataggtcagtgcagcctcaaatcctgggctcaagtgatcctcctgcctcagcctcctgagtagctaggataagaggcacatggcactgtgcctggttatcttattttattttttggtgagacaggcttttgctttgttgcccaggctggtctcaaactcctgactttaagtgatcctcttgcctcagcctctcaaagtgctgggattacaggtatatgccaccatgattggacttaatttctgtttcttccaagcttttctatatgccctttggattcaagagatcaccatcatcagactggctcagtttctcagtgcctcaattgcagatgcctgagaaagagggtttgatggtctttggtctggagtccatatgtatcccattcagatggactttggagggtggggtctctaagaagaggtaatgggtagagccatcaggactgacgtatattctccattgtataaataaatacatgaaaacggaatgaatgattggatgattcatgtgtgtatgaatggaagatgaataaatgaatgagaggtggatggatgactaccaagcccaaccaacccatttaggagagaggtgggtgggattacatggcttctctctatgtcatgggttcttaaccaaaggttcatggataggcttgagaaggtctgagaaccctccgaagtcatctattaaaatgtcgtgtacatgtgactatatgtattttctggggagagggttcatagttttcatcagaatctctaagaactctacaatctaaaaaaaatcaaggaaccctgattatgaatccttgggatttttgttcttgctaaataggaaatgctggccgggcacagtggctcgcgcctgtaatcccagcactttgggaggccgaggcgggcagatcatgaggacaggagttcgagactggccgggccaacatagtgaaacccccgtctctactaaaaatataaaaaaattagccaggtgtggtccagcacctgtaacaccagctacttgggtggctgaggccagagaatcgcttgaacctgggaggcggaggttgcagtgagccgagatcgctccattgcactccagcctgggtgacagtgtgagactccatctcaaaaaaaaaaaaaaaaaaaaggctgttaacattgtgacatcctgagaagcattccttcgagcccagtatatcgcaaagctaattgagccagaaaaagtcagaattcattcattcccttttctgctatccctcgtccatccaattgactcaccaaatttctcaccctctcttcaagactgaaaacccctggccctccatgttatctacttttcccataaataaagtctagtttaaaagtagctgaaagcagagagtttttatttttaactttgatccaaaaatgttgcttgtctccccacttctgtccctttcctggccacaaacatttttgctggttcatctagctgcctgaaaccacagcccctcagagccagaagggcccttagaaatcaatctggtcagagcatttcacctggaggactcagcctccaaaagatcatatgagaatatctgtgggaaattctaaaaatatagtgaatattataatattaaatatacaaagcagaagtatttttttctaacaaaagctgtcaaaggtaaagcttgagaaatacttttgtttagtatgactatatggaagataaattttcttcttccttttttttttttttgagatggagtctcgctctgttgcccaggctgaaatgaagtgacgcgatcttggctcactgcaacctctgcctcccagggttcaagctattctcttgcctcagcctcctgagtagctgggattacaggcatactccaccacacctggctaattttcttacttttagtggagacaagttttcaccatgttggccaggctggtctcgaacccctgacctcaagtgatctgcccaccttggcctcccaaagtgctgggattactggcatgagccactgcgcagggcctggaagataaacttagtaggagtagaaacagatatcacgaggcctgaagcttatataatttgggaagcctcctttaaaaagaatataattaccaataaaaatttagctacaaaaataagtactcttcttagaattaaggaagaaaactttaaagctgacagataacataaacatcaaaagctggaaacatgtttttattgttagtatcataaattaactaaccctcttttataatactttcctgcatctttggctgtattttgctttttctgttcattggacaatgattttataatgtcattttctataaagaggatagaatgaatattctagcatggctggctgaaaattgtatttattgtattttgttttcattgttagcttagacaaatttctttatgcacatccataactttctcagcagtttcttgctgaagtgtgcttctttcatgttggcaagtcctgggaaaactccagcgtttgatctccctcgacctgttccacccatctcccctacttttacgcaagtcctcttggaccaggcggtccccactgggaatgcgcagcctctctttcagatgcctttttgggggttagagtagagtctggatgtgtgttgagtctaccagaagcaagtggtcctgaggactgggtggtctgcagccccacccacaggcatccaggaccactaccagggcatataaggtgacccctcaggctggggatggcttcaagctagagggggccaggtgaggctgcttcctccctgtcctggaaacctcagcttcattagcttccaaagcaaacctgaagcactcttgatttaaatcagaagttcttaaacactttggtattcagaagcctttatactctcataaattattgaagaccccacagagcttttgtttaatctatgggtatttatggtattagaaattaaaacaaattaaaaaaacatttttaaatttatctaaaataattatatgttatataattatgctgtaatacataatagtacatgttagtgtaacatttttatgataactatattattcaaataaattaatgacaagatggcattactttacagttctggaaatctcttttaatatctgacttaatggaagtaatggaagtgggattccatcttccgcaatgtatgtattctgtgatatgattttggttgaaacttgtgaagaaaatatggaaggaagaagaatttaatactcttctcagataattgtggctattcttttaaacctcacaaaagcttgacaaatcgtattttctcaaaggtcagttataatgttgaatctgtaactgtactgatgaccttcttcgtactctgttatattaaaatctcttgatctgtgttacacttggatagaaattttttcgcatcattttgtactagcttgcatgagttatttggaaactattagctcactgacttgtgctaatcttacaaatgttgacatgtttcactatacaatatcaaaattgcatttgtcaatatcatcatcaccttagcctctaaggattgggatgctaataagcttacagtataagatgcaacttttttccccaaacttgagttttgtcattggcaacacattctgccagttattttccttgaagtgacaggctaactttgttattttcttaagagaatgtgtgccaaatatccaagtctgagtaaccatagttcgtctgtcagtggttttttaagtggaaatgatgttccattaaaaaaagtggctaattcatctcataactcaatcgtgtaagtacttttcctggaagtgaccattcacactcctgcatataggagaagtactttatttgagtgcgtacttcccattctgttacacaaaatattcaaaagatgtatactcagggtcaagatttcataacattagtaatttttactacctcaaaatgaacaacctaaagtaaaactggcatttttttttactgcacatatgtgacaatgagggatatgatgactataaataatatactgaagatttaaaaaaagaatataatagttttgtgccactgtcttgattcatgctataaggcaccaaattttactcaccaatgcttatgtgccattagtgcaaatatgaatcagtacaaaaggcaaataatgtcttaatttggttttgaaaatagtttggcctcatggattcctaaaaacaccttaggtattcgcaggggttccatgggtcatactttgagaactgctggcttaaatgccttaagcatccttctaagtgaatcagaggtcaaggaaggagacatcattggtggctgagggagagaaggggaggaccagacatgacagtcttcatgacaatgacctagttgaatactatctttgtaaaaatgaagaaatggaggcacagtgagatttgctccaagtcatccagctagatggtggtagagccagggttaactcctaggtctcctcctgacacacagagtctgtgagcctctgtcaagttaggtctctcaccgaaattatcttacaattatttattgagtacttgttgtgtgccaggtacagggctaggtattgaagatattaaatcaaatgacattgtcatgatccttcaacttggtagtctaggaagcatgcagatgggcaaatcaattccactcgcagttagcacgaagacaggtgatacagagagcacggggggctcagagcagggacgcccggatctgcaagtggctgagaatgtccagaatcgggattctgacactgagttgggaaggaagaatcaagttagccagatcagggaaagtgagagcttttctagtggagcagagcctgtgggaaggcagggaagagaggagtttgagtagctggaggaatggatgtatgggataaatggctggaggtgaggagtgggtgcagaggctgggtcgtggaggctgggtatgtccacctaagaagtctagattttattaggaaagctgtggggagccagacaggctagctggaggacaggctagaaagacagtctggtgctttttctaaattccagatggttgtgacaccaggacaaatcttttgcctctctgggcctctctttccccaagtacaccttgagtcacacagtgacaggcaagtttgttatatgaattccccacctaccattaagagagctgttgaaaaaatgagttcctatggcttaaattgatcccattctcttggcctgaatcttgctacaaagtgctgttcatttttcctatgggctttatggctcaccctggactctgaataaccattacatcagtttagtaaggttgaaccacgtaaaatgtatcatttgtaacctgttgccttgccagactgaatcctaaaaagtgtttctgtgcagtggttttcaaacctggacagtcgtctgaggcgagtggttaaaaatatatggattttcagacactacctcctggggctcaggaatctgtgtatttattttgccctgtgagttgctctgctataggcagcctggccctgattttctgctcagatattttgggtatcgctagttggaactaactaaagaggaacatatattgaatgcctgctggtgccaattaaacactgattcctcagtctcctgcacatggatgcatacaagcacctatgtggctgacacttttcatgttccatgacaggtactcctctttgtgtgagctggaaacatctaactcttacttcatttcccacatttcttgcatctccaactcgatctcttcaaaatgctttccaatagtcatttttctctctttctcctctgcatatgagaggctctgtcatctcattggaagatatcaattggtttatttatttaaaaaaaattcttggtgaacatactgttttactaaagcagcttgaatgactacatatgcaagtgtgcactggctctgtgggaaatgttatatgcaggatcgtggagatcaataaacaaggctgaaaatccctgtataatcataacagtctgggcacgtctggcatcccagcaacgtgcaacatatatacaaacccaaataaatatttgacactaaaatatgatcagttcagcctacaggaaagaacaggctgccagatccagagattggtgaatgggtggtcccatcagagggccagggagcgccacagagtttgttacatttctgacggtcctggaggtcacttaaccctttctaaggtcttcagaacacattatgacaatgtgtcaagtttaaactggggtcacgtccacgtgtttctgttttgcttataggtgcagaaggagggcacatgttttcacagagacttgtgggcccctgggggcgagtaagaggcaactccaacatggtggagagtgccccacttaggcagcagtggtggtgtacagcactcctcgcccgagcaggcctacagccggtttctctgaacagctgcctccgaagatgcttagaaagcactgtataggcatgggccaaaacaggaactcttacaggtgaaggagaattcaagcagcttctagtcctagaagctagagtcctagatcctcaactgcgtgcacaagcgtttctggggctgtctgagaatccccagtggatgtgtgtgtagcagagaggttaaaaaagatggagaaacacaaatcttgcccagtacctcctctattttacggataaagaaatcaaggcccagagggggaaagtggttttccctcagagcttatttgtgtaaggtataagcttggaaccaaagtctcctaaaccccagccctggtcacctcctactcactacgcagcccctttgttctcattgtcatcacagctctcctaggatctgcatggtggttctcattttccccaagctctttcagatttgttatcctgttttatccttaccaacactcctggcagataggaagggcaggtaataataattgccacattttacagagaggaagatgaagtccagaaagatgataaagagatagttaaatttagtgatgaataaggatcctcaaacattagaaggttaggtatccagaggagggaccagcccagtctgcattttcctaaagggtagaactaaggccagtgagtaaattcccagcagcacagtacaggagtggtgtgggctttgaagttcagagcccagatccttctcttgtcaaccggtgaccatagcaagacatttaatccctctgagcatcagccttctcaacagtacgaggaatgataagtaataaattggtcatctcttgggccaaaagcacatgcttaataaataggaggtattatgagggcccagaagggggtttcatttgaacataagaaagacgtttccatcaaagagagcagttggtaagtggaatgtgctgccttgcaaaggaatgagcttgttgtcactggaagcattcaagaagaaactggaaaaccagcagtcagaaatagcgtgcagtaagaaattggacatttagaaaattggatatgtagaaaattccatacttctcgcagtgtcaagattctatggtgtgctctggataagcttgaatgctctgacccctctctgttcttcaaacatgttctctgctgcctagaagcctgttctctctgtccagaaggctcttctttgcctttccatccttcagtctcagcaaaatctccctttcttagagaagcattccctgaccaacctccttcccccatttgttaactcagttgccaactacagtttgatgactcacataagggccaagccaagggtgcaagtctcagactcccaggctaagcctcttttcagcaggcttggctatctgttgaagactaaagtccatccataactcctgcaacatagccaactacactgcaaaacagtgagaaactcaagcagctgctctaccattcagagaacaagactctatgaccattgagttccagtttactaccatatattaagttctgaacatgtgctcagtacagtgccacttgctgggggttcaaagataaaaacaggtcacaatgctcatcctcaaggagaccagctagtgggtaagaccaacaatctttatataagttgaggaaatgcatagcctatcctgggtacttgagaaggggtctccgggctcaaactgaggtccagggaaggcttcttggaggagttgacacccaaacactccagtgtctcacattccttatgatcaagaagattattgttacattatatcttgctgggtcagtggatatattcctggggcaaagctccagctgatgagcattcactgcacctcgatttatcctccagaacttctgcagaagtacaagatgccttcatgacctacacaatgtatgatgacgtcatcaccattaagctcatccaagaggcctgcaacattctgggtaagtatgaaagaacttgttttgctttcttagagctgctgtaacaaaacccagttgattctcattatttgcattggttatagtctataaagctgctgcaatcctgaattagtgaatactgcaccattgttcctaggggaaatacagggttagtttcctgaaagtctctggtcacaagatttttgccaaccaatcaatgcataactttgtttcatgtgtgcttctgtgaaaaaaatacgtatttaatatacatagttgattcattcacattgaactgctggccaactgtactgtaactcatgcctgaaggaggctaatctaacactgcctgttctctggaaggatgtgacagtcttcttgtgcttagggacactagatggcacttcagcctacatttgggggtcattctaaacagcaaaatcaccaacagaaaagcagaaaaatgtgaaaaagatgacactaaatagactgcaagaaggacacttggttatagttcaaactaaaataagaacatagagcacagccttgttctaccttggctagaagcattcatgttggccggtggaaattctgtgtctgtgaatgaccttgatagctctgtgagtattgatttcgggcctacagataaataagtagccaaatttgtgaatatgaaatcctcaaataatgaggaccgactgtatcacaacctgggtggcttaaaactacagaaattcgttctctgtggttcaggggaccagaagtccaaaatcaggttgctggcagggccgtgctctctctgaaggctctcaggaaaaattctttccctcttccaacttcgggtggccccaggctttccttggctagtggcggcataactccagcctctgcttctgtcttcacgtggctgtcttctccctgtatttgtgtctctgtgtctaaatttccatcttctcattaggacatcaagcatattggatttagggtccatcctaaatgacatcattttaacttgattacccaatttccaaacaatgtcacattcacaagttcctggtagacatgaattttaaggggcactctaacccagtacagggctcaggtatgaccctttccatttgagtggccttaggcttcttacagacaaaaatgatgagcagcaccgtctgcaccactgccatcatgtttggcttcgatgttggctttacaggtgttgcaatacctttagaatggtctgctatgattatctctgggtgtcaggaggaacaacattgagaatccgcctatgccacctacactcgtgcttacctggaaatggacgtggggtgctctgcagtgtgctgagggcccttccccgatctgctctccatcgcatattttcccatctgcctggacatgaaaatgccattgacagggtcataggagggggaccatgtgtggatggtcccactgacaatgtacgtgtcctcccaggatggtttttcctgtggatgtattagcactggattttttttatcttgttaatctgctcactccccaggcccagaggggacaaggtacaggacaaaaaaaaaaaaaaaaaaacaagaaaaaaaaaaaagaaattagctctgcctctttctagtttaatgaccgaggacaaatgacctaaatagtcacagttttctcattggttgaacaagatctaatcttcagagttatttggaggattaaatgagaaaatatatgtgaaaatatcatatgtggtatctggcatataataggctttcaaaaaacattccctccctcccttcttccctcattccctcctttccctcactccctccctccctccttcccttcctttcttctttcttccttccctcccctttgtgtttcctgggctgctgtaacaaagtaccaacaaccaggtggcttcaaacaacaaacatcaattctctcccagttctggaggccagaagtctaaagccaaggtgttggctgggttcattcccctggaagctctagggataacttgtctcttgcttctctcccaacttctggcagttgctggcaccgcttagcctgtagacacatctccccaatctctgtccccatctccacaggccttcttccctgtgtgttcacgtggccttctcatattgacagcagcctttggatttagggcccaccctaatcccttatgtcctcaccttattttaactagctacatctgctctcttttcaaataaggtcacagtctgaggttctgggtggacatgaatttgggggcacactattcaacccaatacaccctcgctttctttatccttccttctcaccagcactgagtacacaatgagccagggcaggcctgaggggagggaggggcaggcagcctccaccgtcccaggctccagggatctatgcaggaagccgaagcccccctctgtacccaggatctttgatgaggttcctctttcccttcccgttgaacttccttcacccattcctcataggcggtgctgccttgggtcactgtgagagtgtgagatggcatttaaggatgatctcactcagacgctgcatcaggcctcatgcttgtcacctggcaccgggtatagccctgttggaagtgtcaggctaggcccagtccctgggagtgtgcaagctggctcttatgcagcctgcagagggtctggcagcaggggccatggttttgagttggtttcatggtgcctctgagggcctagcaaattggcttgccattctcaggaacaatttgtgaaatgatataggtttaagccagtagcaggtatcacagtcatcagcccagcaggcgtgcctgagaacacaccagggcagctagctaatgctaagcccgcagggacaggcagcttctccagagcgcagcagtgatgtgtaaagtgcccgtgtcgtgtgaggtattgagcttatttcccttccctttggatttcagaaaaattatctgatgattaaaaagatagtgccagctttacttgcaggcaactggatctgacagatgagagggcttttcccatggctttcacatggcgctgtgactgatatctacatctcttctcatgttcctggtcatctcctggatgcagaagaccttccagggatccatatccaggagaggcccaaagtctctgccaagctgggagggggaagtcattgaggctgaggaagctggatgtgtgtggtgctcagagtcctctctggtaacaggtggtcacctgcttcccctgcccactctgggccacctgcttcccctgtccactctgggccacctgctgtctcatctcatcatgttgctctcttggagccacagagacaagcaggggccagagttgccaacgaggcctggcaggtgatggtgatcatagctaggaggaatctggtgtcccaactggttgttaaaacaacttccaaccagatgtatgttagcccctggtcacttcccacctgcatcttttgatagaaccaaggttgtgtctgaggctggaaataaggcacaaggagtgaaacagtcatttgctccttcagctcctggaactcaggcgccaagagcagcaacacctcccggatgcttcctaaagccagttcccagcctgccaccacggcagcacttagagggaggacacaggcagctggcagacagggctcacgtggcttcccaagaatcacggctgggcctctccccgaatccaccaaccagctccgctctccaaagaagcttacagagagagattctaggccaaagctggcccaggaactgggaagtgtcagtgatacctgcaaacctcacccctatcctgtccagcctgtcttggggggactcccaggcccttttgtctctccagcagctaacaccaggggaggtttctgtggggctgggttatcaaaaagcacacagcatcgagctttctgcgctcgagtctgagagcgggatgtgtcctctttacagcactgtgctgctcccaggggctgcaggcctggagacctgggttctcgactcagctctgctccccagctatggcctttttgttcaacaggtggcagcagcacagccaccccagagggtcacctgtcagcctttatgcttgacacacctgccaaagagattacctgttttgttttcttaagcatcactttaattttttttaaaagtatgcgattacgatgttaaatatgcttttgcaaaccagacagacagatcccctcttgatcctaatatgtccaccccacataggcaaagcctaggtgctgcccttgtggctgacaattctgcacatctgtgatcctagtgagggcaggaggtccacgagcaagtccagtggtttgcaattacctcctttcttctagctaagtaagaggagcatctagtaaccttccttccacaggaagaatacaaatcattaggtggaaattctgtaatgagagatgactacttttgagctgaaaatctggagttttgacagagcttaggaaataaaacggcaaaaaagcttacaatgggtagtgaaattaagcccacctttagtcttttcttgattttattccaagggatcccagcagcagaaggacgtagtggctgtatcgtgtagtcttgatttggtctgagccctctgcgaaagaacatctcgttgttattccagaatgagaatggagggtggattcttttccgtcacaccagctgtgtgaccttgggctagaatttcactgagagttgatctcctgcaaaaggaataataccttacagggttgtgggaaggaatgaattaaatcaaataacaaatgtaaggcacttagcaacatgcatggcacatactgggtgtttggtaaatgtcagccaaatgttgaatctgaaggaaggatgggggtatttctatgttttgtacctctagatactgtcccttataagaagacaggctttgctgttcacttcaaatggctgtggtaaaaaattatgttccacatgtacacagggaggggaacaacacacactggggcctgttgtgggggtcggggggaaggagagcattaggaaaattagctcacgcgtgctgggcttaatacctaggtgatgggttgatctgtgcagcaaagcaccatgacacacatttatgtatgtaacaaacctgcacatcctgcacatgtaccttggaacttaaaaataataaaataaaataaaataaattatgggccaggtgcggtggctcacgcctgtaatcccagcactttgggagactgaggtgggtggatcacttgaggtcaggagttcaaaaccagcctgggcaacatggtaaaaccccatctctactaaaaatgcaaaaaaaaaaaaaaaaaaaaaaaaaaaaaaattagccaggcgtggtggcctgcccctgtaatcccagctatttaggaggcttaggcaggagaatcacttgaacctgggaggcggaggctgcagtgagccaagatcgtgccactgcactccagcctgggcaacagagcaaggctctgtctcaaaaaaaaaaaaattatgttctgagctctctgattagtggtcagcaaactacatacagcttatgggccagatctgggcccttgcctgtttgtgtaagtcacgttttattggaacacagccgtgcccctttgtttatacatcgtccatggctgcttttgtgttacagtggcagggctgagtagctgcgcagagaccatatgacctacaaagccgaaaacatttattatttactatctgcccttcacaggaaaagttggtcatttcatgctctcaagggtggatgcagatctttttcaagattctaaaaatatcttttaacctaagaactgctctggactgaattgtgcccccatgccccaaattcatatttggaaatggggcctttgggaaataattaggttgagatgaactcatgagggtggggccctcttgataggattggagctcttataggagagataccagagcactggctctctcactccctgtcacatgggaacatggtgagagggtgaccctctataagtcaagtaatcatgttatcaccttgatctcagacttccgacctccagaactctgagaaaataaatatctgttgtttaagccaccccatctatggcattttgtcgtggtggccctagtggactaatataagaacttgaatcagcttgtatatctccagaaagaaatactctgtatatatcatatcaccccagtccatttttgtggctgtctgtgctcatgtacatcaaacggtgtggcagtacctccagcagtgagatgccatcacatacctgccccactgccgtcacattcccaacccaaccaacatgtgtagaggcagcagccagtctacagaccaatgtgtgggctggcccacatcacctttccaccgaaagccaacgtacatcactgtggtttctctctgcctagctttgaatgtcaggaatcttttcttcttgtagtttatttccataacatctattggcctatatctatctgaaagagtaaatgagtatggtgaatgcatttttcaaacaagaagttgggatgcaaaatcgagtgaacacatgtatgagatgtggaatcaggacagccccaggaagcccgtcgtgattctgtatgtctccaactcccatgagtctgagagagcaagacccatccaaaggaaaggctacaggaaggacattttactgtctaacaaaatatactggtcagttgaaaatcctccctttgacaagggaaaaagtgtgcttagtcaccactagtgagggctttgctttccatgtgggcttcagaatgcaatttccctaccttgaagcaattgctgggacttttccagaccgctctgccactgcatagctctgtgctttccaattagcataattcaggaggggaccagatggcaggttgagcattgcataaggaattgttctgtatatgaataagtgcctacttagtgtgtaagtgggttattagtgatctgaagcgacaaaattcaaaacaacacacaacagccatttggcacagctgtgtccgtctagactttgcttgcgaagacacccacagtaaaatgtgtttcaacagttagctatcagcaaatgccagcaagcctctctgcactcacatctttaaaaataagaacaacacaaaattgacaacgtcttgaaatcaggcattataacgtttgctcttcactattctcctctgaggatgggacaagtaacccaggctgtgcaaccagccacgaatggagacttgaattcaggtctgctgattccaaggctgatgcttaatcccacagactggaggggaagtcgacaatgtctagagcaagggctttggaatcagacggacctgggtgagccccctggctacaccggctcctgataatgtaacctggggtaaatgttcccctggtaatgcagcaatgatacctgtgacgttttgctcaccttatttgatttcttctgtaggacaacaacccagggggtttcatctgtcctacagaagaaatcaaataaggtgagcaaaatgcctgacaccgagtgggtacacaacaaggtacctcgccctgtccctcacccctgcttgccaccagatagacccctggccccctgctgtggccctggtagggctgactactctgttccaaggtttgacgggaaccaggaggcttcttctctaccaggcttcagcggaattgcttcatccctgcagagcaccaccttcctgagctgccttaatcgacttccagtttattttttctctgtgcctgtataaacttacgactacttctgaaacccaaccctcctaatttagagtcttcttcctccttgcaaactacagcatggacatgggcagatgtttctttccttttcttagactactctttctcctactccaaaatatttccccataaactaactcatgcctgacattagtgatatcattggagaaaaagagtatgtgagattctggctcttttcaggtatctgaagagtaatcctttggataccaacgctttgggggaaaaattacccattttcaacggaaaactttgtcaaatgtagagcatgtacttctctttcctgttgaagagcacatgttttgctgggtgactcaggaagagtgccatgaggaatagctcttgttgcctgtgacttgggtgacgggaggtgggcaggggtcttgcaagtctggccctgagtgggctgtttgtccaggaggctctgctttggtggctatggtgtccctgccagcctcactggggcttcaacaggcgctctctgtcccccagccctggacagcccaactctactctttccagtaccttgagctgaaacccagcaagaagcaaatgtttcccagtgacaaagaagacccatgcttgttaagtcagaaagtttgagttcatgcaacactccaatgtaaaagcttgttagaggtctccacacctggggaatcaagcatagaagctttgtgaccatcattttcctcctggaaaaaaagtcttgggtgggtgttgtaatcccagcactttgggaggtcaaggtgggtggatcacttgagcccaggagtttaagaccagcctggacaacatggcaaaacccccatctctacaaaaaatacaaaaattaaccaggcgtgatggcacacacctgtagtcccagctacttaggaggctgaggcaggaggatcacctgagcctggggaggttgaagctgcgtgagccgtgatagcaccactgcactccagcctgggcaacagagtgagaccctgtctcaaaaaaccgaacaaacaaacaaaaaaacaaacgaaaaaaacccaaccaaacaaaaaaaaaaacaaccaaccaaaaaaaactcaactcctttatttatttaaaaaaaatgttttaatacatacgcaaaagtagagagaattgtgtacagaagcccacataccctccacccagcttcactaattaacaatattttgccagtcttatttcatctatctgattcctccactctttttctagttttattttttctggagtgttttaaagcaattaccaggtttctcacaatttcatccataaatatttcagtattagtctctaacaagataaagacattaaaaatgtactgataatgccctgattataactaacaaaattcataacattacagaggcctgggctgcagctgtatttcagctggccatggataaacatggtctttacggtcttattatgtaagattccctatggtcttttcagagcaatcaacagaatcttttttactttgacataatttcaaacttgcaaaaggcttacaagaatagtacaaagaattcccatgtagtatttatccatattccccaaatgttgacattttaccatatagtgtctatccttctctttatatctagatttatactttttttcttgaaattgttagtatattgcaaatgtgatgccttcttgtccttaaaaattctcttaaataactacagtacaacaatcaaactcaggaaatgaacatagatatagtgctattatctaatctatagaccttattgagagttttccagttgacccagtgatgtcctttagaacaaaagaaaatcctgaatcatgtcacttatcgtgtctcttcagtattctttggcttggaacagtttctgagtctctttatgttttataaaattggtatttttggaaagttctggtcagacattttgcaaaatgtccctcaattgaggattatctgatattcctcatgatataattcaggttatgctttcctggcaggaagatcacagacgtgatctttttccttcccagtttatcatatcaggaggcatattccattcattgatctgtcctattattagtgaggctaactttgatcacttgatttacgtagaatttgccagctttctccactgtaaagttacattttccctttgtaattagtaccttgtgaggagatactttcagattatgcaaatatcttgtcatttctcaaactccctctttcatagttttagtatttatttgtgattcttgtctgaattgatacttatgatggaagtcaaatggtgattttctaagaatattattccttttgtatttattcattgagtttctgtaaggaagaatttccccctctcccccatgtatttatttacttatatcaatgtagatttgtgattcttattttttaaaaacaggctgtaatcctttccttttattatttattttgatgctcaaattgtgcaagagttagccagtgagagccaccctaaactggcccctgtgtccttttgacatgtccccatcattctttgatcacttctttaccttcttgcataacaagatgttataggctgatctcatcctttccctgccccagccctggaatctgccatttctccaaggccctgattccttttacaggagaagagcatttaaaaactaagatctagacattaggcaaccccactgctactgggatatcactgcttttaggccctcttagtggacagtgctggaaaatacatgtcatatacacacacacacacacacacacacacacacacatacacacacatacatccatctttctctctctatatatatatctatatatataatatatatctatatataatatatagatataatataatatatatagatataatctatatctatctatatatctatctatatatagatatagatatataaaatatagatatagatatataaaatatagatatagatatagatatataaaatatagatatagatatagatatataaaatatagatatatctaaaaccatgatagatttcattgtcttattatgttagattttctaatccagaggcacagggttcattctattcctcccctttccataattgtaacttcattctcagatagggaaaaacctggctcccactatccacaatatatttacttgttcagaacatagtttcagaattgctaacccacactgctgtgaaaaggaagcctactaactacagtaaaatatttgtttaaagttctttttgtttttggcctgaagacacagtagtgtaaatactatgttcaaatattactgggttaatttttttcctgggtgattatgttattcaaaactgttctgttgaaatgctgttctgtgaatttgtttctgtttgtactccatcttaggggttttctctatccttgttgatcttatattttatttattttaagcatatgaaacattaacatgactccccaaaccagaactgttcaaaaagttatgctcagaaaaatgtcattttccccaactccacaatttttctaatctttccaccccattccctaccaatgtcctgtaggtaaccaatctcaatagatccaggtttatccttctggtgtttaattttgcacaagtaggcagatagatgattatttccttgttttcccttctttcttacattaaagaatactaagcatagtataaagtctcccctgcactatcagaaaaacattttaaggcacctaagttagtttagttctttcttgcagtttctaaccatttcctgtatatcttggatcccctatgacttagcgggttcttggaatcttaaatacactgatgtgaaactgtataaaagactaaaacaggtgctgatttttttaaaaaagcggcctttattccctgctggacaagcattctcaactaagaattctagaagaagctccaaacccattacaggtggaaaacaccacactcaaacccaagatccttgtttgggaaacagttcatctctcagccagatgtcctttccttttaacagagctgggcatccacaaacaaaataaccagagcctggaacaaacagcttcatggattttttaagtttaaagatttgaaagtcaaacaggcagtcttttacccaaagctgccactcttacttgaatataactttgcttggcttacacgcagcccagtcctcctggcagaggttcttgggagaaggggggccgctgggacccctgcttttcctggcaggtaacaggatgcacctgctcagagctccagcctccaggatgcacagcacagctgttttttcttagtctgaataagctagatcagaggtaacagagggatggaagcaggagagcagaaggacaatttcccatctgtctgtttaccttttagcagtccccctcccagagactcaagcactggaaaggaacttggtagaatttgtctcagatcccctaggggttagcaggtggtccttgaatttataccagtgtatagacaagcctgcctgaggccggccaggatgcacccacaagcaaagaagccaacggaggcaattaacacaggccattaccactggcttctctaccatcccaagcttcgtctagattgagatccgactaatcaatttttggaaaatatgtataactcatcttggaaaatatgtacaactcatctctgacaaaactagaccaattcagtggggactctatcctgctcagattacagaacaattatctgccccatggtctggctgtggactatgagctgtagggaaactgctcttcagaccatcctaggaagcaagcaggggctggagagtgcccagacctccttcgtctgtcctctgtaggatttagccctggatagctcatgagacctggaatgtcccttgctgtgaattccaaatccagccagagcatcacagagtttttcaaggatgcaaccacagatactggtgatggtgagctcttcaggccttccataaacctgggcattacagacatttgccccagcccccaggacttacatgtgtcacagccccattgtaaataagagggtgtttctcacaggatctccagaccagcagcatggatggatgccctgtctcctgtgtcaatgatgccaacgcataagcagcgcttcccttggggagactccttgcttctctcattgctgcttcagaggctgggggatgtggtataaaaagtgctaaacttagagttggagcctcttcaacaaatctggcctctgcaactctatgtgactgcagtcaattcacaaagatgactcagccccaacaggctcagctgtaaaaaggacatgataataaggttagctaccttataagagctgggcaaacattgagtaacagaacagtaattaatgtgtgttgtcagaactataaaacattcttttaaaatgtttgctgtctttcccataaagtggacacttgcttactgtctattccaacagtgtagactggggagcggggaggtgggcagcagctccaactaatgccgcaaatctacctccaggtgttcatcaggcacctatgctgtgtttagcacagaaaacgtgtaggatcgggttgcttctctccagaattaccatgaattaggaagaaaaaaaaatgcaacacttaggaagagagaattcagagaaatctttatggagaatggaacaggaacactgggcctcacagggaggtcaggagagaaagggaaagacactgcaagtatttggtatcatctttttggtaaatcaggatcctgtagccttgaaggcatagttttttcattgtgtattagttatttctcagaggcatccttgtattcttgttagagactgactgttacatttaaagatgtgggaggtgttggcagtgttcgtggagggtcgcgccctccccacccagagtgaagcttgttctgggcactggcttcagcagctaagcgggtacagcatctctgcatccccttctcgactttgaggaagtatttgtcaaggagacttatgtttcacaagcacctactcagtgccaggctgcacggggctcctcccaagggcccatgacatcaatgtggttattggcattttaccgaggaggcaagtgacggcttagagagtagctcgatagtgtcacacagccaggatgtgaaccctttggaaataaatgaagaccacacaaaggacaacacacacctccaggagattttatttagggggtatgctttggtttctacaggtgtctccatggaagccatcctgaaactctttggagaatactttcaattctgaagatgtctggctatgacaggatgctacggacactgggaggaaatctcatggagtttattgaaaacctggatgccctccacagttacctggcactctcttatcaggtaaggccacttgagtctggtcttggctgcccaagaggaagcaaatgctgtggcagtcctgggccagctccccgcctcccccaacagaggcacggttgcaggagaaccctcccatctgcagaatccttggtacctggtgttggtgggctcaggagttctttttggaagagaatgaaaaagaaacacctgctggccacttttataaactggctcacaaaaaccgaagggatggccttttcagatagggtgtggtgttgatttggaattaaatcctggagactcattacaattggaacaaaggctggaaaacagtcaggtttcagtgcatttgcaaaagctctcctaaggtttcctggccaggatggagctgataaattgcatatgcagccagattcatgttattcatgtatcagaagggaagacttgacagggctaagagccagaatcggaaaccatccaactctgattaacccatgggtgactgactgaggtgttaggaaactaatttccctactgggatatatccttctggagttctttccttgggtttcttgtttgtagagatcactggaaattcaaatgcctagattctcttttattttttagacaagaaaaggtgaaagagcatttatacatatcataataatagtttattgctttagagaacatagtttaattttaaggccttatatatttcaccgagatcttccttcaccatttctatattggtgttcatatccaccctttcagggttgtcatggggacaaaatgggattgtggatgttaaaaagcctcagcaacccttacacccccccatagacgataaatgggaaaagtattattttctccatttttcatataaggaatcagaggcttggaagccttaactgacttcaattatgaatcatgaatagttgggcatgaatagctgggcctgtcctattgttatcatgtgaactactcaagggtagagggagtggaaacagccctgcttatggggtcagatgggcccatgagactgtcccactggctctaccacttaacagctgtgcgatcctggacaagttagttgccgtctctgaatctcaatttattttatttaataatatttattgggtaactaatatttattgagtgatactatgtatcaagtactttttaaggtattggacacaaacagagacaaaaaggaataaatagggaaaagataacttacctcatagcaatatgtggattacaagagataagatggaaaagtctagcattgcaatcagcccagaaaaatcagctttccataaataaataataactctattccttcccctttcttttctctctgttcaatatggccagtttaagaattaacgataatttgcatgacaacttcctttcaatttcttagctaaagcacaacaattaggatataaagaaatagagttaggcccttttaatatttttttataacacatatattttttatcctatgatctttttcctttgcttttttataatttcaattttttaaaaaagattcagagggtacatatgcaggttttttacatgggtctattgcatgatgctgaggtttggggtatgattgacgctaacacccaggtagtgagcatagtacccaatagtttttcaaccctcgaccctatcccttcctccctcctctagtagttcccggtgtctgttgttgccatctttatgtctatgtgtattcaatatttagctctcacttataagtgatgctagagaagcaatagaatagaacttatctggtggtatttgaggacattttgcacataatgaggtaaataaaatatttaaatattataatatacaagttggaagaaaatacatgcaatgatacctaacagctatatagtgctttattctgggcaaagtattatagattgtctctttaggcaaaaataacaaagtaagataatgttcactttttttgtgtctatctagtaatttggcagtgcctttaaggtatacatttctggttataactgagcctttaatcttgttatgctttggccaaacttcattgagtgctaattatgaggcaggtgttgggctaagtaatgtgtcaacattgacttaccttcttgatgccataagagtaggcagtcttatttttcctgttatacggatgagaaaactgaggtccagaaagttcaagtaactgtccccaaatcacccaggcatggtggctgagctggacccaaacccacacctgtctccaaagatcctgccctgtgctgttctcattattctttggaataataagaactttgtcaaagatcacgtggctttaggtgtacagccttatttctgggctttctattctgttctgtaatgatacctaacagctatatagtgctttattctgggcaaagtattatagattgtctctttaggcaaaagcattttttttattctgttattctttgccctaattctccacttttaaaaagccctatttgaagcaagaaataaaagtgtaattatattatttagagacttagtgacattgaccagaagaactaaaagcatgaacttttggaagtgtctctgggcagggggtaaggagtgaggggcatgaagcaggatcacgtggactttctttcaggcctctgtattctgttactttattttcactatgtaggatttggatataatttttaaattaactgttaatttcctattttatttatgctttttatatgtgctgcctcaactactctttacattttgtcaagatgtaaacacacatacatacagataaatatatgtactttctctaggtacatacttttggaattagaaaaaaatagtatttgagggctgggcgtggtggctcatgcctgtaatcttagcacttttggaagccgaggtggacaagatcatttatgcccgggagtttgagaccagcctgggcaacacagcaaagccacatttccacaaacaatacaaaaaaaaaaaagtagctgggcatggaggtggcgtgactgtaatcccagctactcagaagcctgaggtgggaagatcatttgagcctaggaggcagaggctgcagtgagccgttaccgtgccactgcattccagcctgggcaacagagcatgactctatctcaaaaaaataaaaataaataaaaaattaaaaaaaataaaaataaaaaagtatttggggaaaaaaaagaaacccattttaactaacaacatttcaccatggaagacgacaaagatcttggaaggaacccatctcctttacctattccctcacttggaccaaaagctgtgtgtccagggtgctgagttgccctctaactagctagagactcccctaggcaaaatctctatccttctttcctagtatacatctcatttactgtgaaatgataggtacttgaatgtcaacatttctggagaaaggggaggatctcttctgatgtatccttgaaggttctacttttttttttttttttgagatcgctctgtcgcccagtctggagtgcagtggcgccatctcggcttatggcaacatcggcctcctgggttcaagcgattctcctgcctcagcctcccaagtagctgggactacaggcatgtgccactatgcccggctaattttttcgtatttttagtagagacggggtttcaccgtgttagccaggatggtctctatcttctgacctcgtgatccgcccgcctcgcctcccagagtgctgggattacaggcacgagccaccacgcccggtggaaggttctactttctaaatgttcaaattgatatcacagaagacattatcctttcagaacaagacattgattaattctacttgcaaattctctgattccctgatgtgttggaaagtgaagatgcccatggtcacttggtcacaggccaagcgcggcggaaactcactaaggcttcctgttaccagcagacagctgcttttggaatatgggtagaaacagcatggcacggtgcaaaggctcatttgggaatcaaatgttgttctaccattaacctaggtttgccttccctgagcctcagtttcttcctcttcaaatggaactagtacttgccatatagagttgtttaaagtacagtaggtatagtataaaattcctgacatacaggagcagaaacagtgggagtttctatgtgattggagagagggttggcatatagctctgtatgatgtaatgggtaaatactattgtttcacaaagcgtcaaaagcataatttacacaatttgtgtccactgggaaaaatgtgtgtcttttaattaggagatgaatgcaccatcgtttcgtgtggagagaggagcagatgggaaaatgtttctccattactactcggatagaagtggtctgtgccacattgtaccaggtatggaaatggcttagctggccgcagagctatggggcttctgaagtgaggaaggtttccccatagattctccaggatggctaataactggctacgggtaagaagttaaaactcttagaatgtgtgacttcatatcatcttgaccactgctcccaatgtccttgagcttttaaaataagtttccaaaattccacaaaaatgagtaatttgtacttttctttcaacattttaaatcatacaggcttttacatagttgtgataattctgcgtatattattttgtatcagctttttatttgcatttagcattgtagaaaaagcatgtttccacataatctttaaaaccacatattaagtggccgaatgatattccatattgtaattatcttaactaatcccctattattaaattttccattgatactaatcgtttgcttttgtaaacagtgctatcatgaacatcttcatacatgctttccatttatatatttttttcttttttttttttgagatggagtctcgctctattgcccaggctgcagtacagtggcgcgatcttggctcactgcaagctctgcctcccgggttcatgccattctcctgcctcagcctcccaagtagctgggactacaggtgcccaccaccacaccttactaattttttgtatttttagtagagacagggtttcactgtgttagccaggatcgtctcgatctcctgaccttgtgatctgcctgcctcagcctcccaaagtgctgggattacaggcatgagccaccgtgcctggctctttccctatattttgtatataaccctgggatagattcccaggggaacacttttttgaacttgatccttaatgcttttacaactgaattttgcttacattatctctaggtttatttgtttgtttaatgagttaaatgcctacctgaaataacaaacaaatgaatagatgccaaactagaaattaaagtggcatggatatatttggtatccaaacatgtataacttcagtctctgcatatttttatttaattggctgtcactgatgtctgatttgaagcagggcctgggcttggtgaacttcagaatattcatcagaagttttgccatttgattattttatgatttttgctgataaagttgccttcggccatccctcgacaataggtgtccttctgctgcaggtatcattgaggctgtggccaaagacttctttgatattgatgtaatcatggacattcttgacatgaatgaagaagtggagaggacagggaagaaggagcatgttgtgtttctgattgtacagaaggctcacaggaagatgagaaagacaaagccaaaaaggttacaagacagtcagggcatggagagagaccaagaggtactgggtttgctgtgcctttagaaagaacagttgcacttaagtagagctacgagtcttggaaaaatctatgcaaacaacagaatcaactggacctttttgtttttgtttttgttttttacgttttcctttaagttctgggttacatgttttgaatgtgtaggtgtgttacataggtatgcatgtgtcatggtggtttgctgtacctatcaactaggttttaagccccacatgcattaggtatttgtcctaatgctctccctctccttgccccctgccccctgacaggccccggcgtgtgattctcctctccctgtgtccatgtgttctcactgttcacctcccacttacgagtgtctgcggctataccaccctgaacgtgactgatctcggaagttaagcagggttggtcctggttagtgcttggatgggagaccaactggaccttctaatagtggaattaaggcagagtttctcagttttggcactgctgacattttgaaccagataattctttggtgttgatggggtgtctttcacgtcatagtgtgcttagcagcagccctggtcttttcctactagtagaacctcatcccctcatttgtggccaaacaaaaaagaaagaaaaagaaatgtctcctggcattgccaagtgtctgcgtagtgggggtaatggataaaatcattcccagttgagaattgctgggttaaggttaagtggatatatactgggaagcattctgggatgcacctgagcctggacaatttttcacctataacaataaccatatgaaggatttgaaatttgaatttgatggcttttttttttcaatcctcctcaaataaattgatctttccagtcttcagtgcccacttctgcagctggaaccagtcataggtcctgagtcaactcaagactctgtacttggccaccccagttgcaactgatagggtgatcattacctgcttaagttaccatgtatgttagctgaacagctctccatgcacatagcttgtgaaaatacccagattaggattagtctctgattccttagagtattttcaaagtccatctcagagtctgttcactgcagaatcttcaaccacaggaagaaatgttcgtgcatgattttcttgccagatatcatcctagttccctcttgagattttctaaaaagttattgctttctttgatagagaaacagcatgaggactaatttgattaaaaaataccgggaacgctaaagtcttggtagaagtgatcttgtaagccctcatgctgttcctctggccatggatacagttccttatttaaaggtggaccccatcacagcaaatggggtttgtgcttctccagtcatgtgaccaggtacctgtctccctgccacctgcaggccctccaggcagctttcctcaagatgaaggagaaatatttgaatgtctctgcttgtcctgtgaaaaaatcccactgggatgttgtgagaagcatagtcatgtttggaaaaggtaagtgagtgattctcccaagctcagctctgagatcagaaagattgcttgattctcaggagtagtggccagtgtacactgacagggccaagccctctgtgattgtgttggcactagtttctgcaaagcttggatttggtgaccatggtttttaactttaaaatgtcaggctctaattgtccttccattgcctctcattatttgtgccgggtgacatggagacatcatctcccctgtcctaagaaaaagtttttggagacacaattggaatcactcccaacaggtgatgggtggagagaaggaagatgagcactgatgtgccatcaggaacaatgaattttccacagctcgtcttctgcagtcaggccttctccatttggacacatttctggactggagatctgtggataacaaccctagtcgcccaagcaaaggacactagatcaagagccaagaaagcaagtttctggctctgtgcctaaggagctgtgtgaccctggacaagagtctccatcttctcatttgcaaaatgcaggcattaggcttgctaaggtacccctgtgggcactgagcccgtctaacgattagcacctaacgcctgagtctgaataagggctctgatccattgggagaagggagttagggtgctctgcgtcacgactcaatgggccaggtgacacgcatctgggagaaggtctgcagggctcaaagggctgcattttgcgtccttcaagccatggcaagtgagtcaaacacgcaattgacatcctttgtctaggagattttcatatcaaaaaggctccatttcgaatctctaccccctgccaaataggactgttggttaaattttcacgtgccacccaaaactgtcagtctaaaaagctccatggcaaatgtccctgatgctgggcccggagcacacgctctgctctgctagctcattgtctggctgtcaccatttcaatgccgactctgtgttcatggcgagacatactcaattggcccagaaactcttcagcggcaggcagaaacttggcagggggcaggagggcttctcaacctggtagcaagttttctgtttgttttaatttggaagaagaattgctgtggccatctggagatgctgagggagtccatgcaaaagaagtgagattgcactttgcttgtgaaacacttaagatactatccctatcccgagctctgctctgtgcaagggtggaggcgggagctgcttctcatcagcacttcctttttctatgtccagggcatctcatgaacacctttgagccaatttatcctgagagactctggattgaagagaagacattctgcaacgcttttcctttccacattgtattcgatgaatcagtaagagactcttccctctgtagcttagaattggggctaagccagggaagtgagcatgatttacagtccttcatgaacagtggagattttcaagtccctgagaaattcccagggcttgggagactaggctttatcctggcaggaccattgatttgcttttcatattgtggtatcctccagaatccattatgcaggatcttcttgatagggtagaaagggaggtttgaactagtgaatgcatgggaaagtttaccattagaaaaaaggggaaaaggaagtgacactaaaattcactacataaagagacagcagaacacagtcagtagcaacaatagggtggaattctacccatgaactcttcccatccttgtgaccaccatgtatgtctccatcccacccagcttcacattctgcctcttgaacatggggaaggggtcatgccaactcaagccactgctctgtaagagttgtgagcataactatttaagtttgattgttaatccatttctatggataaaatatatgtcaactgaattgattaggaactcatttaaaggacacctattttacttcttccttctgtgtgttcactggagatagcagtgaaaggtattcccccacccccttgatggatttcttcacccaggcctgggtgatagatccaatgctatagaatttgctagtttcttcattagtaaatgatagagagagtgagagagagagttgtctcagagagcaaggaggaactattagcccaacagagagctgtaacctcatttctctttagtcggaaataagcctctgagcactctcgtattattcttttctctttcagacattagcacagatttgattgtttcaaaaaaatttattacttccatgatgttgattccattactgaccccctttcccgatagtgagccacagaacatggctagaatgttatttccaaggggaagtttatgggaagggaggttgctttctattcctcagcttatatctgtcctctgtggatagctacaggtgaagcaagccagagtgaacattcagaagtacgtaccaggactccaaacccagaatattcaactggatgagtatttctccatcattcatcctcaagttaccttcaacattttcagcatccgcagatttatcaacagtcaatttgtcctgaagacacgaagagaaatgatgcctgtagcatggcaaagtcggactacactcaaacttcaaggtaatcactcactcctttcctgttgctccccacctgtttgagagattgatccgaaagggaagaggcagttttccaatttcctaaaaagtagggtaggggctacgttgagaacacgttttcttttttctgacgtttccacttgacttgatctgtaaagaatatattttatttcctcaaccatctctggcttagacgtaaactatgtatgtaatatagttacatacataattatacaagtatatacattatgtaattataaaattctgatatgttaccaaaattttcagaatgcatgaggtgctattggtattaaattaatgtctgtattttatgtagcaacatgatcatctaactcactattagtagggcccacattttgtttttaattgtagtaaaatttacataacaaaatttaccattttaataatttttaaatgtacagttcattggtattaagcacattcacacgttgtatgttgtaccttcactaccatccatttccagaacttttttatattgtgcaaaactgaaactctgcctattaaacaataattcatttgtccttcctcaattccccagtaaccagcattctaccttctgttcctatgaatttgacaagtctagatacctcatataagtggaataatacagtacctgtccttttgtgactggcctatttcgattagcataatgtctttaaagttcatccatattgtagcatgtgtcagaatttcctgcctttttaaggctgaataatattccactgtatgaatatacaacattttctgtatccattcacccatcaatggacagttggatttcttccaccactttgctattgtgaataatactgctacaaatgtgggtgtacaaatctctttgagtccctgccatcatttatttggaatatatatccagaagtggcattgctggattatatggtaattctatttttaatttattaaaattaggaacttccatactgattttcatagtggctgctctatgttacattcccatcatggacatcaatggacaagtgttccaatttctccaccatcctcatgaacacttattatctgctttttaaaaaatagtagccatcttaatgggtgtgaagtggtatctcattgtggttttgatttgtatttctctaatgattagtgatattgagcatcttttcatgtggttaatggccatttctacttattcttcagaaaaatgtctattcaagtcttctgtccatttttaattgagttgtttgcttttgcagttgagttgtaggaatttcttgtacattctgaatattaacctcttatcagatatataatctgcaaatatattctgtatgttaccttttcactgttggttgtgtcctttcatgcacaaaagattttaattttgatgaaatccaatttatctattttcttttttgttgccagtgattttggtgccatatccaagaaattgttgccaaatctgatgttgtgaaacttttcttctatgttttcttttaagagtttatgttttagctcttacatttaggtctttgattccttttgagcaaatttttgcatatgccttgaaagggcacacattctgagctatctttctattagagggatgtttagttattccagggataagcacaggcagaactcgggggatgtccaaggggagaatgacatgttctgggaacccgagtgaggtgtagagtggagtgatgggagaggaggctggcaagatgaggacttgaactctatcatgcagctggaaacatgctgaagtgtctgccatgatcagatttgatgtttagaatgatcactctggaggtgtgtgaaggatgggtcacagtgtagagaaaatggatcctgggaggccagacagaggctgcttctggagtccaggaaagaaactctaaagtgctaaactctggcagtggcactggagtggcaattggaggatagactcacaagataattaaggcaggacttggtgactggatgtggggggtggaagagaatcgttaggataattattagcttccttgattgggtaactgggtgatgaaggtgcaattaactgaaaaaaagacataatgtaatgtccttgaggcagggatttttgccagtttgagtcactgctgtatcctcaatgcttaaaacagtgtgcctagctcatcgcagggactaactacatatgtaatgaaagaactaatagaaagagaagatttgtggaggggatcgaagttgagttcagtgcagatatccatgaacagatacctaatagggagaacagaagaaaaaaaaacactgttcctggaggtattaattgtcagaatcatcctagagtgtattttggcaatacgtatcaaaagccttaaaaatgaggatattctttgtctaagtaacccgtgtctaagaatatatctttttaacaaactaactagccatgattatacacaaagactgcctcaagcttattcatcacaatgttgtttatacaatgataagctagataaaatataatcaatactagcttattatttaataaaagacagtatgagcaaggtaaccagcaaaaattaagatgaatatctatatttaatactatgaaagaatatgttatatattttaagtgaaaaattcagattatgaaaagaagatgccatgtaatccctgtttttttgtaaaacaaagatatactacaaaatattaacagtaattatccatgtggtatgattatgggtgatttttactattttctttcactttttttgttttctgcaatgaatgtgtactgcttttacaataacataacaaacatatctatttttaaagaaatacacatattgagttcaggaagcaaggtttctctggaaattcagatgcagtcagcgtggtgtaggatgcagttgtgtgatgctaaatgagaataccaagacaaaaccctcaggaacactaacatttaaggaatgagattaaaataatgtaagtaaaaattcaaagaattaggggacatctcagagagaaagcagtgtcagagaagtcctaggaagtgagatttcgggaagaagggtctggttaacatcatcaaacagcagaaaggctgagtaaagaaaaggccaaggaacttgtgttggcatcggtagcatggaggccattgatagatgggagccacttcaatgtaggcaatggacacagctgctagggacagaggggagataagtaaggtctcacagaccttgggtaaaagagaaagagcgtgactgtgcagtaactagaagcacacagtgtgggagatgattggttgtccagcgagctcgtctcagtccctactggtgacatactctactgttgcatttctctccatgatggcaaggccagatgatctggatggagtccatgtggtgcatggtgtacctgtgctctccgaagctccgcagcctgcaagagctggaagaactcaatatgcatctttctgacatcgcccccaacgacaccaccagggatctcatcctcctgaaccagcagcggctggctgagatagagctgtccaaccagctggaaaggaagaaggaggagctacaggtcctctccaagcacttggccattgaaaagaagaaaacagagaccttactttatgccatgctgcccaaacacgtggccaaccagctgagggagggcaaaaaggtggctgcaggtaaggcaccctctcctccacagcgtcctctgagcagagcgtggtatgtcttagtggtcagggccacaggctttgaagccagacagaagtggttttgaattctggctctgtcacttgtaagtggcatgatcttggggtaattactccacctgcatattctcagctttgttctctctacattaataataataataataaaaataatacaggagtgaaacatgaattatataaaaatggttgtcaactacacacacattaaattctctaagaatttaaggatatgtcctgagactggcctcattactcagtgacaatgagtagggttcttaactttaactagaaataatacactcgcacactagttaaatcatagggttcctctgaggaccattctgggacagtatactatttatggaggcagggatgctgtgtttaccctgaactcactttccgtttgtcatgggattgtgttcattcaccagacacgcctggtgaacttactctgtgccagggtgctgttccagatctggggacacagaggagtttacagcctcatgagtttgatagatatatgcagaataaattaatgggggtggaaatgaccaaaggaaaagaaactaatttgcattaaggagcaattattgtgccaggatccatgttagacattttacatgtgcagtttcattaaattttctcaacatttctatgaaggaggtgttgtccataccatattgctgagcaaattgacattcagcgcagctgataaatgaaagaggtggaaactaactgcgttaaggccatctaactccaaaatccatactctttccatcacacaaggtgctatggcaacatggggacagggaaattaataataaatagatgtcaggagataagagataggggggtgggttggagttgtggaggtacctctcaaaagtgtgtgacacttgagttgggccttgaggctgaatttcagcaagcaaagaggaaaaaggcatttttggagaatgggctagtaagagtcaaagttaaggcaatgtgcaaacgaataccatggggcatgttcccagagcgtggggtatgtggaaaagtggggtctggtgacgctgagtgggtagggtggggttcaggtgatgcagtgatgaatttggactattagggaaaaggaaattgtcttttgtaggcagtgagaattcattgaagtttcttctcttattatggaagtgacaggatgagttttataaatccgattttggctgcagtgtaatgaatgcatgagggggtgctgaaagaccataagggcgcagctgattgatggtagaggcctgaattagggcagcctgaggaagaatcagcaggatttcctcactgaccagatggggaaggtaagacagcggaggcaggcatgggtctgaggcttctcgcatggaaaaatgggatgctttatcctaagacagggccagaaagaagagcagggttgggggagaatgataaggtccattttagaaccattgagctggagatgtctgtgggatactccacacagcatgatcagtggtaggaatcttagtgagagctcataggaacattgtggcatggagctatacatctgggagttattgcaatgtgggcggggttaatcatagactctgaatggtggataagatcacctagaggacaggaagtgagaagagagtggagtattactctttagggaacatctagtgcttaagaaggttgagaagccaaggaaagatataaaacaaggagatcagaaaggtaggaggaatatgaagagaggatgataggccagaagccaaggagaagggaaagttccacaaaggggaaattaccatcagaggcttaactaacaaagaaggcacccggctgcattcaaggagtcattgattcactcactcaatatttattgagcatttactatgtgccaggccctgctttaggtgcttgggatatggcagagatctaaactgacagtctcccgtctcatggagctttgtattccaatggggtggtagacaataaccaaataaaccattccatacaaaatatcaggccgggcatggtggcttacgcctgtaataccagcactttgggaggctgggtgggcagattgcctctgctcaggagttcgagaccagcctggacaacacggtgaaaccctgtctctactaaaactacaaaaaattagccaggcatggcggcgtgtgcctgtagtcccagctactcgggaggctgaggcaggagaaatgcttgaaccaaagaggtggaggttgcagtgagccgagatcatgccactgcactctagcctgggtgacagagtgagactctatctcaaaaaaaaaaaaaaaaaaaaatatatatatatatatgtatatacatataatgtcaaatgtatggagtgggtggaaggcaatcaagctaaaaggatagccagtctaggggctattttatacagggtggtcaggagagttctcactgagttggttacatttgaaatgtgagtaacaggccctgtagatatttgagaaaagtgtcaggcagaggaaacacctctttttttaagtgtagaagcctgaaggcaggaggcacttggcatgctggagaaaccccatgaggccagtgtggccagagtggagggagccggagggacatggggtcagagaggtggcagggacagaggtggggggtcccctctgtaagccatggtcaggactttgggttgcattctaagtgtgatggaagtcatgaaagatttgagattgaagaatgggagatctgacttaaacagggcatctggctgctatgtggaagttagcatgaatgggggccaaggtggaatcaggggcatgatttaggagcaagtgttcaggacaaggtaggtttcctgccattcaaagacagggacccatcacttcacagtgaccagtctctgtcagccctgtccccaggtctcctgtagctcaggctctgcttggcccacttgctaggggccctttctgtcctcccacagcactggtcacattttactggaaggatttgttcacttttatgtctccttcattagactgggggctccttgggggcgagggcctggtctgcttgccccctgtgatatgattctcctactacgactagcttgcagcgggcactcagtaaacgtgtgctgggtgatgctgaatggggaatggcatccagctacttttcccacaaggcacagggcaggtttgattctcacagggcctcttaatccagaattcatggacttattagtcgatctccttgtttctcactgatacctggtttctgttgtaggagaatttaaaagctgcacgattcttttcagcgatgtagtgacatttactaacatctgtactgcctgtgaacctatacaaatagtgaacgtgctgaattccatgtactccaagtttgacagattaaccagtgtgcacgcagtctataaagtaagtgtctgtgcagtgtggggtgtttcacggtgtgctcacgcagggcgagtgcttgattctaagtctccctttgcctctgtctgcactggtctggggtttggtgtggatgagtgtggggtcagaataaaagctgaaagggaattggaagtattttaggaattctagtttttagaaattctttttacaatgctcagtgctaagatggcactctggtgcccttgaggggcacctagatgtcaggtgttttcatagagtgtagttctcctactcctaaattcagcagaaaatcgaatctaaacaatgtgttatctcatatatagcatcacatgactaccccaggagcttcgtcttttctgggatttgtttccaccaaaagcagaaaggccttttggctctctcatggttgtttcctgagtccttttctttctcacctcctccctcatgctcctcatacccttagcaaagaatcaattaccagctttagtatagtccctttgtctatatatggaaaatgaaaaaaagtgtagtgacatgtttagtgcatgaaggaatccctctgaatacctatttttttttccctgacaggtagaaacaataggagatgcttatatggtggtaggaggtgtaccagtgcctattggaaaccatgctcaaagagtggctaattttgccttggggatgagaatttctgcaaaggaagtgacgaatcctgttactggagaacccatccaggtagagagcaactgagtacttggcttaatgccaaacatctcacacacaaaagtagaattctgcttatgtgcttaggtgattactgggtaagttgctgtcattaaaatgggtaatgtatcctagcccttttcttctcttgcatatgtccctaatagagatattcctaaggctcctatagtctcaacttttctcaaatttcagaggaggctgcggtgctcaaggttttcctacgattgactgcaagcttcctttgttggtaattcaggacagtgctgagcagttcttcctatttacctagcagggctcaatccatcttaaacaccagctcatttataattcctgcttttatgttcaagcatttcaacaagtggttcaggtttaatgagcagccaacttttcctgcttaggaaattgtgtctccaacatgccatctgacaggttcagaactcaggctgaggtgtgaggctgcctgcagtcagcaggccaggcaccgtgatgccgtaagatattcagaatggctttccttccaccaagtggccactagcgagacatctgctcgcctttctcacagaaaagtacgcttccaagtctggaagtttgttcacactctaaaagttgaacagttttggaggtgaaaaatgaatgtcctcctccgctggctcagcagatcctaatgctcctgggatggctgagagtggcgtctctctgcctttgatttctaggtccttcctctgctaatatcagtcagaaatttaaaataaactagtcaattcaaaataaacaaagccaattataagatggaatatgatttttccacattataactttttacaggagattctgaaaatctgctgcactcactctgaccatggtgagttagaagctgagaaacagtgcagatcatggctacagcatccactgtagtcttctaagtaaaagctggccttagatagtcacaagaacaagatagctgccataatgactcattgtaaacacagtgtgcatcagtggaataaaaatccaatgtaataaataaaaaatcaggatgagaggcaatgagggaagagatataagaaggttagataagagataaatgtttcagttaaaggatgcttgtgtaagtcactggtgaaaaataaaaataaaaatggaaagcatagtgtgcgtgtgtgtgtgtgtgcgtgtgtgtgtgtgtgcatgtgtgtatgaaaggggcatagcgccagagatgaaaataatgctacaccaataagaatgaaattagacaatgaattgttggaaactctcaaggtggatttaccaagaaaaaaataggaaaggatgttagcaattccaaggtaagactatggacataattaggagcatcattaaatatccaccagaaacagcatatcatatgggtttattcaaggatgtaggggagagaactggaaacactttctctcttaacagaattgtgcaattattttgcactgagatattctattattttattcatatagctttaatatacatttactgagatccatccatgtatgagacagtattactaggtgctttgaagggttcagagaatcctgttttcctagagaaattataattttatttcaagcagaagaaaatctagcaagtaaaaacaacaagcaatctgattaggatgtagaaagctgtaagagactgttgttcccatgctagcagttttttttcccccaccagaaagcaaaggaatcaaaataaactaaattccaggaagtgacaaacctttcaaagagaagacacccataattgcattcaatcctggcagggcagcagaagaagtaatccaccagaggtgagggtagggataatcccgtctaaattttagtggacttttaatggtcacagggctgaaacaacaggttagaatgccaaagagtcccagccacagagtctgtacccatctaccaactcttcctcataggccaagtgcaggggattagtcagccaaaaactaggacaggagaggagagctgagagaactcccgagtccctgaggtgtttggggcctttcccaaatgcaaagcagtggcccattaaaggctaatgttagagtaagagaactgagagaaatccaactgaagtactcttcgtcttcaccaagtacactacgatgaccttttgaagtatgagggcaaggaggaatggcagagaaaattttcccaaggtgcagagagccagggtgggactgaagagcaaagagacttctgaaaatctcactgttgggctgtaatgcaggaggagatctcctacaactccaaaagctgtggattggctgtacagcattcaaggtcctcagagtcttgctggtgctcagattctaagctctgctgtactgaaagttctgattcagccttcataatatttgaaaccagtggtgcatggaatctaccaatatttctggaaaagccctgacccaactcaaatatggattagatttacttactgcccattccagcagcctaattctgtagggatgtaacattttctggtggataaatattatctacttcagtctctactgtattttcacacacaatatgggtcattcaattagataatgaaaaatatgagatgcaagaagcaacaagaaaatagtaatatagtggatagccaatagagaaaatagtcaatagaagcaggtccagaaatagcctagatgttggatctttaaaattagtgtgataaatattttaaagggtctataagaaaaggggcaaaacaagtgtgaagatatgggaaatacgtacatactgtctatatttacatctatatctatatctaacagaaaactatgatatcagaaatcagaaataaagaattaattttatgggctcaacgaagactagacacaatagagaaaaaaatcagggaatttgaagacagagaaatagaaatcacccaaactgaaatgcaaagaagaaaacagggttaaaaaggggaacaagacactctatatctgtaggacaatatcaaatggactcccatatatgtaactgaaatgctagaatgagaacagagtgagaatgggtaagaagaaatatttgaagagataatagttgagaatttttcaacatgaaggatatcaatgcacacatccagagctcagcaaacccaagcagaataaatacaaagacaaccacttctagttaaagcataccaaaaactctacccagtgaactaaggcaagaagaagaaatataagacattaagtttggaaatgaatgaagaaataaaattatcattattcacagaacaaataatggtgcacctagaaactcttatacaaactacaggaaactacaagatctaataaatgagtttagcaaggtcatagcataaatacaggaaaattaattaaatttttatatgttaaggacaaaaaattgaaaatgaaataaaaagaaaataaacttaattaaatttctaggagtaaatctaacaaaagatacatatgacctctatgcttaaaactataaggtattgcttagggaaattaaagaggacctaattaaatagagagatataccgtattctttggaaaactcaatatatttaagctgtccattttccccaaattgatgtatagattccgtagaataccaatcaaaatccctgcaagcttcttagaaaatattcacaagctgattttaaaatttatatggaaatgtaaagaatctagactaacccgaacactcttagaaaataacaaaattggaggatgtacacaactaattttaagacttattctaaagcaacagtaaaaaaaaaacagagtgagattgggagaagaatagacaaagagaccactggagcagcacagagtgtccagacatagactccatgtttagtccattgatttttgaccaaggcaccaaataattgagtggggaaggcaacctctttttaaaaaatgattctgttaccattgaatatcatgtggaaagaaaaaatgtacctcagttctaccttaccccatatacaaaaaaaatcatttgatatatatcacaaatcgaaacataaaatctagaatcacaaagcttcttgatggaaataaagaatagcatcatgactttggggaaaacaatgatttttttttttttagataggacacaaaaaacactgaccatgaagggaaaaaaatgataaacttcattgttacaggctgaattgtgtcttgcccaaaattcttattttgaaactctagtactcactacctcagaacatgactgtctttggagctagaggctttactgagtaaaatgaaaccttaagagtaagccctcatccaacgtgcctgatgtccttataaaaatatgaaatttggacgtaaagagacactaagaatgcatgtgcacagaggaaggaccacgtgaggacacagcaaaaaggtggacatctacaagccaagcagagaggcctcaggagaaaccaaccctgcccacagcttgatcttggccttccaggctccagaattgtgagaaataatttccattgtttaagctacacagcctgtggtattttgctatggcagcctaagcagatgaatacattcatcaaaattaaaacattctgcttattaaagaaaataaatacacaaacccacagactgataaaaatatttgtaatacatacatattacatatccaaatatgtgtacaattcatacacattaacaataaaagacaaacagctcaatttttaaaacaggcaaaaaattgaacagacttttttacaaaagaaaatatatgaatggccaatgtgtgtgtgacagtgtgcctaacatcattagtcaccaatttaacgcaaattaaaaccacagtgagatatcatttcacacccacgagaagaccaaatgatggtgaaaatgggaacaactgaaagtgtcacgtcgctgatagaaatgtaaaacagtaaaacaactttggagaattgctgggtagttttttggcttgttttgttaaaaaataaaattaaatctgtatctaccttgggactcagaaattccacttctaggtatttacttaagagaaaggaaaacatgtctacaaaaatatctgtacaggaatgtttatagcagccttaattttaatagattcaaactgaaaaataatctaaatgttcatgaaaaggagactggataatgaatgtggtgtattctaacaatagaatgctattcagtgataaaaataactactgatatgtaagacaatatagatgaatctcaaaaacattatgttgagtaaatgaaaccagatataaaacagtatatactataagattgtacatatgtgatgttctggaacaggcaaatcattctttggtaaaagaaataaaaaaggccaggcgcagtggctcatgcctattatcccagcactttgggaggctgaggcaggtggatcgcctgagttccggagttcgagaccagcttggccagctggccaacatggtgaaaccctgtctctaataaaaatacaaaaattagtcgggtgtggtggcgggggggcacctgtaatctcagctactctggaggctgaggcaggagaatcgcttgaacccaggaggcggaggttgcagtgagctgagatcacactgcactccagcctgggcaacaagagtgaaactccatctcaaaaaaaaaaaaaaaaaaaaaaagaagaaatgagaatgtagttatctctgctgaagaagatggggagagagcttaactagaaggggcacaagataattttgcaaggtaatggaactagtttacattttattttgggtggtggttacagggatataagcacttgtcaaaactcatggagccaaacactttaatatctttttttattttatgtaaattatatctcaacttacaaataaaatcaagagtattagatggtctcttttcagtgatgctgtctctgtacagctcagagtggggatccatactggaccagtcttagcagatgttgtaggagacaagatgccacggtactgcttgtttggtgacactgtgaacacagcttctaggatggaaagtcatgggcttcccaacaaagtgcacctcagtcccacagcctacaggtagccttccatttattcatgccttcctttgtcccttcctctttctagaacttacagagtgcctagcagccatgggttggggtagtgcaggaaactcatgtttttccttccatgtctcaatggcttacagaagatattgtggcagataataaatttagttgagcttctaactgtagcatagtttttactgtcaaggagcatatagtttagttcagggaacagcaaagtataaccccacagaccaaatctagtctgctgctcatttttgtaaataaagttttattggaacacagccatgcactttcatttacatatagtctatggctgatgtcatgctacaaaggcagagttgaatcactgcaacaaagaccatatgatacacaaagtctaaaatatttactatctggtctttatttatataaaaagcgtgctgacctttggtctagcagaagaaaaaagaaaagttgtagttgattatttttaaagtgagataagtacaatgacaaatatgtgcataaaacaatacttatagtttcttgagcacttaaaataggccacattctattctaaattcttttatatgttaattcatttacagttgcaacagctctgtgaagatacattattattattatttacatgaaagaaaaggcacaaaaaggttaatcatttgcctcaggaccaggtaggctaggaaggagaatagcccagatgcagcccacggagtcagagttcagtgtcccccctttaactgctgcactcttatcctcaaggtagtcaccgggggtgtcatgagagcccagggcaagggtgcttgacccagtaaaaaagggcttcatggaggagattcctgagctgaatcttgagcaaggagttccagagtaaaatttagccaaaattggggtattgggagtaaaaagtgggtagaggctcacatgtagaataggtgcagagaactataaacacccgaggttttctgtattggaaaatatgaggcaggagcagtgagagctgcacatgccttactgaagggcaagagccctatgccgtaggtgaggaaaagcccccaacgaatgtgaggttgaagacagtgacagggtcagggtcctatttgacactgaccactctagagaccctgaaagggcatatttgagaaccagaaaatgagacagatgagacctgttaggagtttggtctgaatcagaacattagtggtgggaatatgggggaaaataaaaccagctaaagtagttagaaatgggggatgagaagaaggggggagcccgggtctccattctgggtgactagggcttgaatggtggcctggccatctgcaatgggacaaatgagaagtatcccagatcataggggcagacaatgagtttaggttggacacgctgggttcaaaggaactgtggaacattcagctagaggtgccataaaatggatggagttgagttattgaagatccagacttggagtaagcaacatataggtggtaataacagtcatgagagttgatgagatcaacccagggaaggatgcagtgtgcaaagaacagtgggaaaagaatggaatcctgtgcagaaccaatatttaagtggcacagaaggaagaggagcccagggaagagacaggagaagaaatactcagaaaggaccaggagagttgagggtgagaagcactcttgtggatgactttaggaaggaagaattgaacaaaaatgtcaaatgtagtaataaggactgaaaaatactcactagaggttttggggacattctcaaaagtggttgtagtagaatggtgggatagacgttgggctgaagaataaaaagaggagaaagtttgcatgagattaaagcaggtgagaggctgttttgtttgtttctgtttaggatggaagagacataagcacactgaaaagcagaaggagaaaggcaaatggaatgggagatgaagataagcgtggggtggccaatggagcaaggcccagaggtggtgggaagggggtgagggtgaggagaccctggacaagaaatatacctcatcctcggagattgggggacaggatggtgtggtcatggggtgagaagtcacaggctctcacctgtaatcaatgtaattttgtagatgaatcagggcataaagtaggaggcacagccaccagcgtatgagtgaggggagcagatgccaaatggaggcccatgaggactgtggtgaaggtctgaactctctaccaacctggccaagggcaagggaaggctcgatggagtgccgaggcaggtggtcatgaatttgaatcctcattggtctgagtggttctttggcttttctctaacatcacttggtggctagtaaataaataaacagggaaacgttttgtaattaccccatagctctgtctcttttcatggtcccttccctatagtcctcctcttcagttccttggcagacagaaattgtggtggagaaagcttgggtagttaggatgagcatagtagcaagcatggggtatatggtgcacttggggaagatggaaagaagagtgttgatacccaagagtcttacgtggcagaaacatgaaaggtggtgtccacatgggcactgacagcatggtgtgtagaaacgtgagagatgcccatatgagggttgagctggagggaggaaaattggtggcagggttgggagggttttgatgggtccctgtgttctcttttggcctttggcatcctgttcagaatatctcatcctcactttccccacggcctctgtcctgcttcagcaggcagatgtctgggatcttccctcccctgctgttgtgtgtcctgtgtcctggacttttcctcttgagtagccctttgcattgtagccaactcttgagttacagacccacaatctttgatatctgatgcactttttttctctgtgcagagccttgaaaaatcaagggtttaaaatcattgagaggggtgaaattgaagtgaaaggtaaagggagaatgaccacatactttttgatccagaacttgaatgccacagaggatgagatcatggggagatctaaaaccccagttgatcacaagggtaagcaaaaaagagaagctttgtcattagtgttgagtagtttttccactaaccacttcagatatgtttattatttgcagggtcaacacagaaagcatccttgcccaccaccaagctccagggctcagttcaaccatcttgccctgaacactcttctcttgcatcctggttattatgacgttctttgagctgggccgatagatccagctgaagagttctacatacattagtcttcaaggttcttctctgggcgtttcccatgcagctctctggtagctggggaatgatttgtgagtgcttcctctgctccacagcctcagaggctccagcacaggcttccctcgcgtgctggaacctttttcacattttgttctagcttccaaaactgggatgagggacaaaatttgtgactcacccagctccaggaatgacaagagggtgggagtttagggtaaaaaaacccagtactaagctggaccagggattactgtttggctcatggtacccccaaaaagaagctggaatccaatggcgagctctccatcagctgcaaggctgatcagtcccacacactcagggtcccttagccacagcctggctaagacagaagtgctgacctgaaggggaaacctggtaataggaggcaagcctttctgaacctccaagaagggaatgaattccttctgacaggagctaatctttagccactccagaggcccacaaggggaatctcaaagtccagaggttccttatttacacagctattacacgcagtatgtctctttgggacatgtggattatgatgactatttttaaaagtggggctatcccaaagaaaagatggattatttgaagaatttttaaaattgttgtcataatgctttcattctaatatcagctcactgtagtatccctgtgagctatagttggtttaggccacattttactgttgtagacactgagatacaaatatctaaataaaaaacaagaaataactttggtaataaggacgaggagcagtcctcattagaggttttagccccagaatttccaggctctgggcacctcatccactgctatctcccactccctcccacccaccatcatgccagccccacagtacagagggtttctagagagaaggcaaacaaacatcccccccttttctcttcttcgttgtcaagaaatgaacaaagtaaagtggggagggggcatcatatcacgtgatcattggagaggggaaggcagggctggaggctttggcacaggacagggcagatgggtctcagctgtgcctggctgtaaccccacactgctctctcccactcgttcactgagggttcccacacttcttagagaaacagtattccggagcaaggtctgagtcagtagaatcaaacccactttcagttctgagctagggaaaagcaaccctgagtagaaagtgaggaagggtgcctcaactgggagccctcagaatggagcctgagaaagaggagggagggtaggtgtgaaaggagggcaggggatagcagcccccatcccccgaggccccagtcagtgtctctgtgcaaattaagaacaaggacccctttgtgggctatggggtcgacagcccccagacatggcttatcatagaggaaaatggcaacctctgtgtggactgaggtcagtcctcaccctgaaccccttggccaggtgcctccatgtagagaaaactgcacaaacatatatgtggtcccaggaaggaaggatcccaacccttttcatgcttctgtgcatttcccagtcccctctccctttccccagcagccttggatttcctgctgtgagcctcagccaccaggctctgggggagggtgagtctgtctctccctgcctgccttcatctgcagcatgggggctctagcaggaaggccaggaactctcaggggagacctcatgcagatactgcttcctaaggaaccccattaacttccggggtccagggtgttttctcccagtgaccactgacatctccatgaggcaagatagagcctctcaaagacagtgatgggggaggggcatggaaacactgttatgttcactgatactcttttcacatgggtctattccctcagattatctcccatgggacacacacgacttttttgggggggttacttagggaggagcagcagcgagggcacttcagtgattctagtgtgcagtcagcattaagaactatgtctaagaccaaagcaatgcagaagaaagggccctgcagggtctttcttgtgccccactccaccctagcacaaaaagacccagaaggtgacagaaacaagaaaggatagtgtccaggagagctcttcctcaaatgagcctcctctcctccacttcgttctcaagacagtgcatttcctcgttctaggtaatgagtacatgaaacacgttaaatgtccttcagcctccctaccacgacatccaacagctggaacttccatccagtccttcacatgatgggcacctgtgggaaacctgccaggggcagccgatgttcagaggcatccaaaaaaagtctcccacttcggcagccatgaagcccactcatgcaaccgtcctcacttttccttcctctcacggttttttgcagaagcaagtgctcagggaaatgaagacaggagaactgctgccgtcatgagctatgccgacagtcagcagctgatccccgacagaaacgcagcagatgcagacggtgagtgcagcaggcctggtctaaaatacttccagccttgcattgctcataaagacaatcggacacttcagaggtcacttcataggcagtgagaaagagccgggaagggatagcacaggtggagtttggtgtcccggggcaggacgctactgacttgcttgctgtattttgaataaactgttgttttgagcacccctatcccaggtgtcccaagggctctcattccggcagggccatctatactcgcttccaaaagaatctctaataccagaaaaacgtattactttctgtgcatccacaaaacaaagtttctctggacagcgtggccctcagtagcttgccttgtcttgctaaggagagctgagacttcctcttcctgcactatctggtgctttacagagacctcagggcattgacacttccgcagagtagcccagttactctcttctccactttgtcctgagggtcgtagggacaggagggtttgcttaattcatgcttattctggacggccttggcagtcattcagctccctcagagccagagccattctcaggactgacaaggcttggtttttgagtatggagtcacaaaggaataatgaagaaccagggatgggtggacaacatgaacccctgtagcagcagctcccccatctttttctagaaccctcatgctaggtgatccgtgtggagttaaaagcggcacggccacagtatagaggggatcacatctcatgcattttctaaaaaccatctctggtcactgagacaatttcttaagacaaatgaaatgatccatgtgatgagttagaacagcttaataatccatataaaaagtctagctctcgttatctttattagacaatatctctaaagttgagtgttgcttgagcccttggcattggcactgccctgatgcccaaaggcttccctctagcttgatcctagaacctgaggttgagggaatgaatagcagcctcctgttcatttcaggtgagaggagacagagcaaaacttctctcactctgatcctggggtcagatggacatttgcattctgggacatgagaagctcaaagcaaagtttttgccattgcctggaggcatttccctcccgtccccactcctctccttcctggagttgcatgtttctggcagtgcccaaaaccctgaatagttgtccaacgtattacaggatagaattataacactcataggtccatttgatagtgttccttggaaaactgttgctgctgcaggaatggacaaagcatctagtcactgtcctgggatctgcaatgctcactgaactaaacacatgagattcctgcctttgggcagcttgtggtttagtagagggaaacagacaattaacatgtaactaaacaaataagatcattggggtagtgatgaatgttaagaaaaaaataaaactcagtagagggccagtgaagtcttctgagagggagcagcatttcagctgagacttggatgaaggaagaaaccccatgtggctacctgggtaggggcttccaggcagcgctgtgcccaaggcagaaacagccttggcaagttcacaggagacaagaagaccagtgtgcctggaaagggctgcaagaggaagggagacatagggatgaaatcagacaggtgtgtcggggcctgggacagtcttggccttgagactgcttatcaacgtgcaaaaaagcatgagcatgaaataaggggtaggtgaggaggcgctggggctcccggagaccttcagagggagaacggctctgccatttgaattcctaaatggcggttccataaacagttcagaagggaaggtctaaaaaactctttatgctccaggaagatgagtaaattaatttttcaaacttctgctgcgtgggagatggggaggtcctgccacagggaccagcagggctggatgtcttgcttagaggtgagagatagaaatttcacagcacctcttctaactgtggctttcctggacaaaaagcaacactgaactagagaaggaaaaattgaggccacctcagttttggggggaaactcgagcggtgaactggcatttttttggcaactactttgtgccaggcattttacccacattatcttatttacacaacagttatataaggtcccacaactagtaagtggaagaaatagcatttgatcttcatttcagacttgtttgtctagggcagatcacgtccgtgtgagttcattttgagcatcagaccaagacaattccatagtttccctaagtggtggccactgcacttgaactgcttgggttgacaatggcccagccatttgtctctcagatcctctgggccccatctgaacagatctctgattgttcggtgtgattagcaggtgtattaatgaggaagcactcccacactgtgggttcatgacagactggtgtgcaccaggagtgccactggacccaaagctacccacaccgagacgtactgaaccagaaactgccctttcacaatgtgccccagtaatttgagtttgggtttaccactgacatgggcttcttcctcatctttgacagttggcagcagacatagaatttagcagtggaggactcatgccacctgctcatgggagctgcctcttcactgtggttcgggtcccggttctcatgggttttcaggtctagctaggtctcctatatcatgcttagctctgaagtcagtgaaggctgccagagggtcactgtgggagcccccagcctcgtcactacccctgggccatcctgcccggcccctatgtgggcatcgcgatggggaagtgtctgcatcagtagccatgacctgtcaggactcctcagagaccaacctgcttctcaggctccaggcagctgggtggacgttcaagacttgcttcgttcatcatctctgccaccaatctcaccaggtggtcacctggctgccaaacatgatggctcttcagtggcacaccattccatctgacttggccctcttgggtgggaaacgggcactcctggccccctctccccggagaggaccgtggatcctgacaaagtatctcagagtcttggtagcctgtgcagctgcagcgcacctagacttctctctgctggccagctgaggcctggggctcacgcgtatctcgaccctctttaaaaagggggccacagggagtccctgcaaggcccaaccaccttctgccagggcagtagggagcgctcagcgggacccaggcctgcaggctgcatggaggacctcatttgcacttcaataacatgcttttctttcacttaactatatatcttggtgttagatttgtcagtggagagactccctagtgcaattaaacgggagtattgagccggagagaaatcagtgtgtgttgactcagatatttaagcaaccacctttcagtattgactcagaaattggccttccagctgtccctgctggcagactcttctggcatctcgtcaggccgctgttaatgtgtttttcaaatttcaacttgcttcaacttgtctcctaactgatcctcctgttgatgacaataatggtttccaggctgacctgcacacagcacttaggcaagcagcccaggcccctctctggaggcgaccccttccttataaatcacagtcagagggcgtctgcttgctgggttcatggcaggttaagtcagcttgggggacttctcaagcaactcctaattgttcctctggagaacttgagtggtgagggtctctctcctgatgaggttagactttagcggtctgctgctggaggggttgggttgctgattccctccaaatttcactcactcttccaaacaggaagaacttttccaccatttgcagtctccctgatgagtaattattggatgggtttgtggtcacttaattaccagggcccttgccccttgctttacagagtcgtgactatacgagcacctttcccagacgtggccaattagggggggcccagctggtttggagccaggcttctaaggaaggctgggtccctgttctcagctccgagccctttctgcagcctctctcagtccttcctaagtgtggctgtcaaactttgctgacctttcccccttggggctaatgagtgtcacagctatttttaaccttgggttttctagaagttgagccgttaacctagctcctacagaaggaggatcctgggaggtataaatgaactcttcacacacaaggaggtgactaatggaggaacataggattttcagtgtcagggctagccttgaagttttgtgttgacacccttgatagcatcgaccagatgtcaaatcagagctggtcagcacaggcggcatgggtgggagggcagccagaccatctgtggaacaacctgttcatagtatagacggctgagcctcacctgagagggatttggcaagtctgcagtagggctgtgactggttcgttaaccaactttataggggattctgatgagccaactggcttggggatcaccatcgtgatggaaagggcaatagactgaaatcagaattccaggtcctggcagtcagcgacctgtgtgttacttcgggcaagtcctcttcaagacatttttctcatcctgaaggcaggggtaatggcgggccttcttcacagggttgctttgagaaatagatgagatagtatgtagcacctgaaaacagcagagtgtcaggtgtgcggactgctgagtcacttgggcattcattcgcttaacaaatatatgggtcttaacacaaaactgtaagaggtactgcagaggtttgtttttttttttttaaatacgatctgttgtgtgcgaagagcttcagacaaatgggacagaggaatccacatgggaagtcaggctcccagccttgtgcagggcgctccagcatgacagtgtgcacaagtgatgctgaaacacacactgggatttggaaaacctcttagacaaggtgcatgcaacagcagaaacaagaataggcaaggatctgctctggtctctggaaaatgtggggacttctggaagctgggaatttatttcctgcacggcatggcctcttttgttcatggatggaaagaggcaaccaggcagtgtgatcctagaacagccaccccttccctcatcctggaaatgccactgcactctttgtatcgctagggtagaagtatacactcactggtagaatttcccctaaaatttcatttttggaatttgtgtctcttttgtctgttcacacatcccctgctcttcctctaggatgagggtgaacgctgggaaaactgagatggaagcaagtgggagcggtacagggctctgcacaagtggagaccacacagagcaaaggccagtccagggtggggagagaggtgggacggtggcacaagccctgtgctgtcaaggaccaggatggggtgaagcggtgaatggggtgaagcggtgaatggggtgaagccgtggtggtgcagggccctggagaagactgagtgcctgatttcaggctcaggccaaaccctccaccccagtcgtggagaatcagtgttgaaaccaagatgtggtcttccatatcttattctgtttagaaggttagaaacagatgcagaaatgctatgaagtgattatcttaatggcaattgtaagaatccttcttgtaaccccatatcatatcgtgtatgattcatagagcctgcctgtgataacaggtgatgatccacatcccacctctattccccaaggcaacagcatttcctcacattccatgctgctatcgctgcagccactaccacccccaactccccagcctccaagtttgtgtttgacaatctcacatgataggtgttttccaaatgggaagatttcttctgcaaccattcttttcatttaatctgttcttgatctacattgagatagatttctgtgctgattttaatactgagctatgtgatttttccaattaaagactatttgtttatttgtattatagaagaaatatttaatttttaataagtatggataaaccaaaagaagaaaaccaaagcacctataattacatcattcagagagactactattaaaatatgggtcatatcttccctgacttttatatgggaggctgtgtatatgtgtatacagacatgctttttcttacaaaaatggaattgtcatgtatatactgttttgtaatctggcagggcatgaatttctttcctttgaacatttaaacacttaataatactgaggaggataattttaaaaagatataatgtgcttcacatggtacccttatttcccatgtgacttgtgctattacatacccccaaaccacttttacattgtaccaaatgaaaatcccaattatcttatactacccacatctacaacacactttggtacccttgatgttccatgagtcctgaagtttcctctaaattttccaagaaagactaaacttgttcaagttagctttggtgcttagagtatcccaggtgtctagatgtcagcaacacatggaagatgtaccttgtaatttctattaattggaaaatgtaattaaccagaaggctacatttcccaactgtgcacaacaatgagcattaactgtaacaaaatgatggtactcataggcagtccttgggggttgtgaacaatggttttgtgggagcgaaagatgatggacgagaatccatctcaagtaaacaaaattcttccagcatctggattgtggaactgaattggagtagaatgtcaaacatatatgtgtgaaaattccaagacagccttgcagttctgcgctgaccaagtcttgtttgaattgtcagaggcatcaacccaaattgatggagtcaggtttggcttgtccaactttcactgtgctgtttcagttcattttctcagcacagtcctagctgattgtcctttctgtctgttctctgttcactctttagggagagaaaagggaaagaagaaaatgaatttaaaggaaataggagtagaagtggaggagatggaagatccagttaagatacaagtgagagaaatgaaaaatggtcaggctagaagagagaaaaatgtgctatgaggcaggagagatgaatcaacgctgaaaagctacatttctgagaagagaaattgcaaggggaaaaaattagagtgttgaataaagaggagacgaagatatctgtaaaatattgtttcctagtgttgagcttactccaaaataccttatgagaggttaggccagaaaatagattattccttttggttacaaagaaatcatggtgctctcaggaagcaagagcagatcatgaacacagcctgacagctgctgggtacagggaatggtttcctttaccgtatttctgctcattttagcaattccagccctttccagctcagttttcattttcactagagtgacctccacttttcatacaattacaaacatacaaaacaaataagttctgggatcacaacacttttgtggatatttttttctctcaaagattcttataacatttctttgagttgagggggagacagatgtgttgtgtggtgttgttttacatctggagaaactggggcacagaggagtattgggggagagttcagctgctctttgtagtgctgttgggtggtgatggatgtggaggcagatgaccaggtcttctcaacagaaaaaaattacacttccatctgtaatcaactcattttttctctatttgctatgatgacaaaacaaaacggaacccaaatttcacaaatacactatttttatcatttaacctgcatgtttccatttttgaaaaatttagttctaattataatagtttttacatctcaaaaaatacaatactgcaataaactccataattcaaaatgaaagagagtattgggaataataaaattagtagagaatcagcaaaaagcaaaaacaaaacatcctgtatctgaataagtaacagtttccaaagagcataaaatactgctgaatataattcagtcgtgtgtgtgtgcgtgtgtgtgtgtgtgtgtatgtgtgtgtcagagagagagaatatgtaatagcaatcaaatgaacatatagctaatgatatctgtacttagctaactctggttgcgccataccctataaaatgtcacagttgagagtttcatgaaccttgattccttttcagattggccccaatatatgcatgagctaaacgcttcctgtaaatcattgctggaagttgcctcagtgacatggccctacatgtcccaggaatccccctttctctgctccagggccctctctccaattttcacctcattctgggcctgagactgagatgagactggggagaggtctggtagccccaaattttccacatgtatgtcatcactgacattcctcaatgagcagtgcattagcgaatggagcctgtttctgtctcattgtttgtgctcttaggatcttaaaacaaaaccgatcactaatccaggttcaggatgaagtctgagtgctaacagcctctaatagtgaaaaaaaaaagtcatccattattttgggaagagaaggccgaagacaggagcccctcttgatttcccgctttctataatactagatgtacgtgagcctcagacctaatacatgcgcctttctgaacttgaatatctctgggacaatgatttatatttttaaaaaaggaaatggcaatgatatatgactttaaaatctcagacgctgcccttccaaatgaaactgcagggaacgcgggaggagatagattcagtgtcctccacccggcctctatcccattccttctctgatcccactctctctcttgccttggctcacagtcccggaggcggtttttctccagggccttctcccagggctccctcccatgcttagaaatactaattggcatctttgagtttgtgctctatggggcattgcgtgactcacttggtataaatcatctagtttaatgatcataacaaccctggaaggcaggtgttatttctccatttttcatatgaggaaaactgaggcccagagagcttcagtaactcatccagggttacaggtcaagtagtggcaatgctggctctgaccttcagcctccgtgtctgctgctcagaagtcacagacagccacaggccagaagacaaggagacttggtgctattgtgtgagttatgcagaagcaaagatgtgggtatgaccaaaaagatggcacagggcagttcaaagaactcatatagccacaaggcagtggtctgtccgggctgtttggccttggctgtgaagaattcttcctgtccaggatcacactgagtagaaaaggaggcccgtagtgtccacacgtgttccccagggtctggcccagacagacagtctgaggctcgatcacttgctcacccctctgtgttctttcagctcctgatgaaatcatccctgtggggagtgcagggccagatggggactccatggagacagccgaccggcgacagccttcagctccgacaaagacacatcaccttgcaaatgacactttgccgtctggtttctgtgttttgttgtaacaggttaaatgaacccctgggcttaattttccccctacttagttctgtggcagcaaagaaaagtgacttcttttcatttctcagctcaaaacttcttaagccgtgtctcttcctcatcatccctttgagaataaaagtctagaaatgaaacacaa

SEQ ID NO: 117 - DNA, 48670 bp, Homo sapiens
ttggctgggaagaggtggcaatcagggcgggccaaggcggctgttctcgctccagctcgatgctgcctccccggcccggttgcgctgtagccgctgccgcctctgcctgggtcccttcggccgtacctctgcgtgggggctgcctccccggctcccggtgcagacaccatggtaagtgctctcagccgggtgcggcccgaacctcacccctcctcggccggcctggcagcgagggaactggccgcgcagccggagcttggctcgggggccctgggcgctcactgccggccacgggagcagcctcactccttgcccgcgcccagtcaggggaggtgggaacgccgcgagtcgtggcgggggcgatcggtgcctttgcttcccaggcgggtttgccgctccacaccgcagcttcctgagctcgggaaggggaggtgcggcggaggcgtggggtcttcccggctctggccggccccaccagtgtgggaggctgagcgccagcggaagggaaggctccgggttcgcgtccccgcgctgcccccgatgcccagcctctcccggagcggtgacaggtgaggagggtgggaagatagcgtgggggtggggcggatggtgacggggagaatccaccagggattggggggttgcgcccccacgatccgactcctttagtgcatagtacccctaagggagaggagtcaggggcggggtgaaaggttaagccagcgccatgggagcagaggcagcagcctcgcccccaagccgcttctcaggtacagcgggtccctgacgctcaagtctctccctgtccccgcagtacggatttgtgaatcacgccctggagttgctggtgatccgcaattacggccccgaggtgtgggaagacatcaagtaagtggccggctaccctggctgtggcccaggtcggcgcccagtgtgggaggccccccgcgcctcgcctggtcctcagcctgctggccgggtcgcgggcgcgcatccttggaggtgcctccgcgcctcgctcccggctcgctgcagctgcgctcccacgctccgggactggaaccaggaggggaggggcggctggggcggggctgcgagggcgagaaccgcggaaaggagcccctaggggtcaccacggcttcccgacccggcctgagcgtgggaacgcgctgccggcgctcccaggctcagcaggccgggcagctcccacgcgtgcagagccccgagggaccacacgggcctccgcgaggttcctgcgcccggaggccttagaaacaaacggaagactttggctcctttatgatttacacacctggcgtaagttaggcctttttggtatgctgaaacacgcgggagattatttcttgagcaacagtgaattaagcgcatttattcatttttaaataaagtgaaaattggaagttttttgttttccccaaatcccactgcccaccccccccgccccaacccctatcccccgtttttttctactgtgttgaagacttaacagttctaggaggcattctactttcagtcctggagctttgagcccagtactggggatgtgaacggaaataccacacccacctgagagtttaaacctgttggaatgactgatgggtcagcatgtctgcaggcaggttgactatttcactctaataaagttgtctctcctttttcctctcactctcaaaaaatttgcatttaacttatggtacagctgaccaccaccaactagctactccaaaaccctatttatggattttcatattagagcaacagtcagactatcacattgtaacaaaggtggaaggaagggtttcctgggtgggcagatgggaatacactgttattattcactctgatttcctgtacttagtgatttcattttgttgtctcaggtaggtgaggcttccatgctgtttttccctaagcacattacaattattagcaatcaattctaacaggccttattatgcagttacatgatggtgatttctcataacgatctgtttccatagaaatgaccagggttatatattaagcacgaaaatgtaacttttctttcccctggatctgtatcactgagcgtttctttcatgtttcagaaaccatttgtattatccacagggcatattacctacatattataaacagaagccgagatttggcaagtatgtggttgaatccaatgagaacataggcaccaaaagttactttaggatttgaattttctggccatcttaataccattataatttttattttgcttagtagacagatatcaacaaggcagacatcaaaaaaagattgttaacagtataacttaactaccgaattatttttaagccacttcctttgtaaatttataaatgctatatatatatatattctccatatgatgcttttgcatctgtaagatagaaattcccaaatttgctggtagatatgctatgacaatgaatatgcttagaatttttagagcagaataaaagatggctattatgattaaacagtcattatgtaatttaaccagatttagattgtatatcctagccattatcagtttagatcactgttaaatacagagatgaaaaataatactttatagagtaatgtatcagacattttaaaaagttaaaattatccagagatttgtttatattgcttatattttcccagaggaagtccaaatatgtaaagattcaattgacgagaatttaactctgcaaaatcaagctgagaatattgttccattctactttaaaaaattatttattaacttactaatttatctttaagtagcttccaacagtattcataatttgtctaaaggataaaaattccaatcatccacaacacaatttttctggtaaaaatgaaacaagttatattggtcttttcttaaataaaattgcctcaaggttatgcccctgcaagggaaaaagtgttagtcacactggtgttggtaatccaggtgttagtgttgattctttatttgtctaagcatcttttggtggaccccagctgatcttgggtgtggtttagtgtctgggctagagaacatggttgaactctctgcactgagggcattaaagctgctccttggtttccaacccaatacccctgagtaattactaaatgctccctgggagagcatttgctttccacagaaaagaatcttgctgcctggggagaggggaggagaacctggaggagtgtaattgaaaaatgctccttgggtgattctggttcctcctcccctccctaccctctgcttcagggaatattaaagcagtcattggtccaagatgctttcagttttaacttttataagaaattgaatataagaggaaaaacatttttttttgtctcagtaagtaccaaactcttattttttcttttggtctttgagaaactatctaaattgatgtttatacaaatttacattatacttttttgcttcactaggaaatggccatccatccttcatgagaaaggatgggaaaagatgccaaacatttaatgacaaataaaaccctaagtaacagattccagacagcagacagaaaattctaagtggataagggccaaaaatgcttcattgtaaactcagtatccacttacactcttaccaacaatataaccatttcacaaaagctttgaattcctcttaagaagaagaaaaattgtctagaccaagggccagcaaactttctcttaaagggccagatagtaaatgttttaggtgttacaggccaaggtaaaactgaggatattatgtaggaatcaatataactattaaaaatataaccacttaaaaatattaaaaccattgttagctcttggaccaggaaaacgcaaacaaacaaccaaaccagacaaagtgggctacatgtgatccatgggctatagtttgatgacctctgatttagaccataacaaatgtgaaaaagcaaaagagacctctgaatccatttcaaagttttttttgttgatttcatttcaatattcaaatagtccttttaagaggctatgatttctaagtaatgacaaaaaaattatcagggtagaaaataaataaagttaggagtgatacatcctagaaaagcacctaaatacttgatttcccatctctgttatccttccatcagccctgactaaactcatcattgcgtcaaattactgggtttaattttagattttttctctgctttctttccatattttttctgggtagcagcggagggaagcagttagagacaggtcttgctgtgtgcccaagctggtctcaaactcctgtcatcaagtgatcctcttgactcggcctcccaaagtattggattatatgcaccaccacacccagcccaactttagattttttaacctcactgaaacatacaaattaggaagatagatccaaaacactgaaaaatcccaaatgattaaaagtctgtaaagaaagtacactgtcctgacttaaataaatcagataaaacgtttatctttaatgagtatagtcaagtgttttaggcactgaggatagaaaagcaatgatgtaatccttaccttcaaaaaaaaaattctagagatttcatgatattttagtcttattattttgtttttattttcctgcctataactcaaatacggtaaccttttgtctgttggatagcatatacttccagttttgaaattaatgtgtcttgttaaatttgctaatcacaaattaatcattatggttcaaataaggaaacactttgctataaactagttatgggactttccaagttgcctaaactttccaatcctccattgcatagaggaaaaaataatacttcacagagctgatgtaatgcattgaataatgtctgcaaaatgcttaacatagttcttgacaatagcttaataaatgatgatttttttttattttactctagaatcagagtttttaaactttccgttccccaatttacttgaaagatattaagccctcctttaaaaaatattattgcagtctatattctatcagtctaaattttttttatcactctaggataagtaatcatcatcatcatcatttttcatcattttgttttgaaatgcaacaaatgctcttaatatccattgtatcaaagcaaattaaaacaaacaaaagagcacatcaccatgttttgccgtgtttattcagattttcatatttttgaaggtgtgatttaaacttctatacctttctgtagatctgcttaagtagtaatgagcctatgtatgttttaaagtagtaaggatactttatattataaagcaatttcaaatttccaaagttttgttctctctataattttggttgactgctacaacatccatttgaaataggaaaggactttacagctcaatttttttaataacaaagttggttttccaagaggttaattcccatatgtaattacttactgtcccagagaattacatataggaaactgaaaagtcagaacttcagcccttgttcttctgttgccaggtttaatgcttcttttaagatataactgtgaaataggaactaatgtagtatacatacaaaaatgaaaccacatttattttcttacccagaaacttcctcagtacaaataaacacattaatatacagactaaggaaacaagtaaaccagatcattgttaggatcaggatccttttctgtagaaagatctgccagttagcctgaaatacagaggaaggcgttgcattgtattgtgtgttggctgttaagcttactaatgtttgaagttatcttttgcagctggaactggatgcccaagtgtatactccatcacatacctgctattgagctctttgcatagggctcttccagaacctggaccatgtctgtgagcagcatggcaggcacctaggtgataaggcgggtcatcacatgatctcagggagtttgtgggtgtttcttttgagttttattttggttctgatgatctgaggtatcccccagaaatcaagctgggtcttggagtctttattttccttgcattctgtgatttttgagaattaaaaaaaaaatcagaggagtacatcacttaatttggcgtgtcggaaggatctttgcacattacggtgagcatcagaaatcagaaaatctgtattctcactcttaatgtacccagatctagttttggcaaacatttactaagcattgttatgatttgcaagaacaaagtcctttctactttcttgcctttctccagaataaggggctctagcaaatgtttctctttaatgtgttggaaaactatagttatgggttgatgctctgcagacatcaataggaaaacacacttaaggaaatgaatgctataaagaaatctaactggctagatccgagggtgacagctcagcagacgtgagtacttgcagctttttcattctctcctttgcctccttgttcgttaaagaggaaatggtgggagaaaaaatgtctttattgtttatgtctagcaaaatgaagcatctttttctgtgtcaaactatatcaaaagatagtgaagttaaagtggattttattccaggtaaaagtagacattctgaagtatttattggacctcctcgttactgtggctttggttctgttgcatattctggtctacttccccttcattgttgaatcatgaaatatgaaattgttaaatttattgaaattctttgtggtcaatcttcagataacccaaacatggaaacctttcactcaacttgtcctacatacccttagcattccagccccatgggcctgtttttagtttctcagccataccgagccttaaatgtgtccgtttaacacctgtgcttgctatggtctccttttcttcaccctcccaaccctcctgtaaatgtaaacacctctcagctttgagatgtcaaagcaaatgtcacttcttaagggaaccttctctcacatccaaacttttccctttccttcatagtgctgtaatgcaagagtttgtacttagtatttgtactactgattaatgtctatcctccatgacaatagcctccataactctttctagagtgctctctctctccctctctctatgtattcaataaaatatcaggctctctttctgtaataaaaatatggatgtttatatgtgaatgaagtatctttcacctttttcatttccaaagaatagagcacacacatatttttatcaaagattcttctctgcaaccagaatttatgtcagcatggtgacatattcaactactatttaaatataagctgttttcaaatagacatttctttttctccaagatttattgagatataattgacaaataaaagttatatatatttaaggtgcacaacttcatgttttgatgtacatatacattgtgaaataatcactgtaatcaagccaattgccatattcatcacctcacataggcaccctctttttttgtagtgagaacacttaagacctcccctcttaacaaatttcaagtattcattatagtattgttaactgtaattgttcattgtaattgttaatagtgacattgctgtgccaaataaacatttcttatatcagcaaaggcagaagatagagcaatatagcaatacataatagcaattccttttggaagtgtcagagttcttttatgttttctcatgtcatgtggatgtattggaaggactaagaactctattgttagaatgacaatttcatatgtcaaaagacaattactagattggattcaggacatgattgaatcctttagcaagtttctaaaaggcagggatgtgtggtgctgtttaaagtcagtgtcatagactgtaactcagtgtttagaatactgaaattaaatttgaaatccagctgagctctcaccatgtcatgctatttcgaatgtaatatgtcacgtatattaaacacataccatatggttctgcagtcacagtcctagatgctttatactcattatctcagttaatcctcatcaccaccacagaaaatagattccttcattatcctcattttgcaaatgagagaatagaggcgtaaaagaaagcctgcctcaaacactcagctattaattattagagctgggatttgaacacagataaagttgtaattatcatgttatgtgttttcctccaaagagaaagacctataaccttcttctttccaaagacaaccaatttagcaaggacatgtgccatgtttatgtgtattagtactgcctgctgctttttcttttttcttggaatgttcaagcatgcgtacaggtgatttttgacaacaatatttttaaaggcgaattgacatgaagcatatacacaagtgtctaagtaaattcatttgtctgttaaagctgctgaaaatggctcagcagctcaaatgaagatttgtaagttttgtggatatgttttcaaaattggagaaattaccattaagggtctcttgtgactcaaaattggagaaattaccattaagggtctcttcctgacaattgcatgtcaggaagaaacatgcaattatgtatcaagactgttgttgtttcccctaaaactaaggtatgggtgtcactcaggagagtatttattgttactgtttacagtgattggatgagtgagtgaacacattgacatgaaaggactgacctttactaactaaaagggggttcaggcaggaagtcgttactggatttaaagggcctgtctctccacttggcagctccctcaagccagagtctctcctttggggttcaggcttactgagaatcattagattaggccattgaaaacttagaggctattcatgctccacagccacttagaaaaaagcaatataaagttttacttttttagatgttatatatagttactatccacagtttatagtgggagattttagttttaataatggttggggacaatgcaacattatggtaccaattcagctcactacaatggaccattctaggatttattatcaaaacgacacctacgtactgttttttaatacagcatgtgttctgataatgttgtttatgggatcaatagtatcttggagctgtcattggtcagtttgattgtttgatcctgattgaccttttctgcccaagagcagaccttgtgttgagattatgttttcaacatgcctgtgttcaggctctcccatttcaaaatactccatggaaaacttctttaactgaaatatagcagtcttgtcatattcttaacttactctaaaaatgtacagtagcaggagctcagggtcagaatatgaattcagtttttctgtgttcacatattgtagttaaggaatatctccttgtatgtgaagttataagaaatgttacctggatattttggacaaattgtatacctagttttaaaaaataaataataaaaaatattctttagtttgaaagcaaatgatggacttttgttagtaatgtttgattacttgtttgttttttttttttttttttgtagggagcttggaaatgtgtggggaaattgatttcattaattcattcactaatttttaaacatgtatacctttattaagcacatgtgcacctttattaagcacatgtgcaattccaggcacctgggttaggcaccagtaattacattaaagaaaaaaatcccaacttaccaaacaccaccactataaaaataccaactacctctttgtgaaaaggtaattagtataaataaaggatctgcttaaattccaacaaataagagtaagtaggaagttgattgctactgggaaactatttcacttatacgtattcaacttctaaacagttactgtggctacagatacaaagaatgtgattatttctgattttgttgccaggtgagaattcgatctttatttttaaagcccttaggggcaacagagcttgtttgtttcttggctattttagtttgtaaattctatcagcaaatctgcatactaagtgcaccttaattatttgattctgactaaaaatgactaagattttgttgtcattcttcccttctcttcttccacttgccatttcctctttctcctttttcccttcttccttcatcttctccaactactataacttaccagttagaggaagtatcaggcattaagtgtgcaagaagtactaccctgagatttttgcataggttaattctgctaaccaacacaatgaccggaggtaactgctgctgttagcctgttttacagatgaggaaatgaaacaccaagagttgaatctgcccaaactgcacatgggattggcttagttgtttattttccatactgtgtgaggaaagactttgacttatgacatagatgaaatcaagggagtttctctttatctaggtttacttgttagccaatgaaagtgcttttaaacttgaacctctctaaatatttattattgtctgctgacctctttcattgagtaattcactgaatagaaaaatttaacgcttaagccaagcagagtcattgggtatgtaaatatggcaagtcatagtatttgaaaatagtgaaagactatgttcacttgggatttggtaggacttttaaaaataaaaataatagtagtaagcagcaacagactgtaatacaaactaggaggcatgaagattgtagtgctgttggttattatttgatagatgagcactcttgaacacagtttaatccaatttacttagagtttatatgatattttttgtcatctaagaagcattgaaaaaaatgacagtatgtccaaaattttcagaaaaatcttaaattgtggttctcagggaaacctgtggtttttctcacatgtaaaataagtacaatttaaataataaggtaattgcataatttccctattatgtaattatataattacataataataatgtaacaatgtatacataatgcaacaatttaaacaaaattggagctcaaaaaataattctgaaagaatgaatgagtctataaaatttggtgaatgtacttggctgaatttggataatttaagcccatataaattctacttgtcacaaaaataaattttaaattactagaagtgttattcttgcctttgctcttgaggaaagaacttaaaagttatgggatagcaaagtgggagatgcagaattatgagataatattacttgaattatgtaaattgtttatgtaatctgaatattagcttacttcctaacttttcttaaatttactggtcgccctctgtgacttcaggtagcagataaaaaaacagccctaaagctaaggagagaaggaagcctgcagtgtgggaagggaagccattaaaactttcctcaaagaacagtggcagctatattttgcagagtgctgggaaatggttattatcacatctctgtgctttctggaggttaaaacatttgacagcatgaagtccgattatatataaatttacctaaaagttagaagaaaagttgtattgagaattgagagacaacagagaaggcttggttgattcaaaatttctactagcttcaaaggccatattatctgaaattaattctcttagttattattccttcattgtatattctccatctcagtttagtgtattaaactgcttcatactaaagagtttgcgatacctccaattaacttttgcagtatttccaattagcttttcccctgaaaggaaagaagatgaagaataggctagagaaggaaaggaagtggccccagaaaggttaggtataaggtggtaaggatggaggtttcctgctcaagtccttgctccggcgtcactgtccccatgaagcctaccatgaacacctatgtatattatcctcatatgtatactgcatccagccccttcctcttgcatttccactctcatgtctttatccagagctacctcttcctgtagtatctattgcttcataacatattatatcattttgttatatatcatgtttattgcttattacttgtatctgtcagctaaaatataagctttatgaggacagggatctttacctcttttgttcattgatatattaaaagtgcttagaaaagtgcttggacataataggcatccaaatatttgtggtaaaactgttccataagaaaaaaagaaaaagaaaaagggtagccccacattcccaaagatgtaaatagagtcctaagtactttgaataattcaaaggaattcagagtgaaatttttaaaagaagattattatttccttccatgtactactgtttaatttctatttcagtccccactggggagcattgacactggtcatttcaggaagtaaagctttgatgataagggagcttattttaataaagagagagaaaggaaaggaccaatgcattgacccatggttagggggtttctgaggaaatggctgttcccctgttttatgcagagggactgtggattctgcttgtaccttgtttatttatgggttactagagattggtgagtgtttcaaataaacagagtttattacagaaatttatgtgatttgatttattccaattggaagaaacagaatggtgaaacatgaataaatttctacttattgtatctttaattagaatattctgtcagagtctccaaaattttaatctatagatcagtgttgtttcaaaataaaatgttaatagcaaaatgacaaaacataaggtatccatatccgtcaaactatttatcccattcctaagaatttgttctgtttttacatagaagtgtaagaagctataaagatattcataacattttttatacttgtggaaaaaataaaaacatctaactacctaccaagacttcaatatgtctacaatgcaattttatgcagccatggtatagaagtataattatgatatgaaaagatatccatcaaatattcactcaaatgggttttaaagcagtatgttctatatataagtatattcaagcatgaacaacttgaaaattataatagcagtgattatctcaggatagtggaggcttattttctctttttagtttttcctttcctgtactttatatatatttttacaattagaaattagaatgcagaaaatatatagtagcatttatcagaggataagacaatgtttgtatattacgttttcataattttttgatatctcactgacttttggtattaaaaagacttgaggtcttcgaagagttgtgttgcttttgtttaacagctgtttatgtttggaaaaagggagaagaatttaatattttatgtacagtgctataattgtttgagtagacatggggagtgctatattcactgggaatatgtatagtactttaactgcttagaatatacttttgtacactttatctctttactgttgtgaaaggtgaattatctgttgcttccacttcagaaaagagaggttttgtttgtttgtttgttcgcttgtttgttagctgagtcaggatctggctctgttgcccaggctgaaatgcagtggcaagatcacgcctcactgaggcctcaactcccgaggctcaagcaatattctcccacctcagcctcccaagtagctgggactacagacttgcgccaccacacctgcctaattttttttttatttctaggagagaagaggtcttggtatgtcgcccaggctgttctcaaattcctgagctcaacggatcctcccacctgggcttcccaaagtgctgggataacaggcatgagccaacctgcccagccagaaaagagagattttaatgcttatgtgctttatgtgatttgctccggttcatttagctggtaaagcctgggctctgaaatgcagatctctgtgcttacagaaaacatgcttttaaaaaaaaagttatgaataaatgcaggcaaataaattataagctctgaaggacagaggatgtttttaagactatctgcatactaaggtatggatgtaagacataccaccatttggaatttttcccttgagcatacacagatatagtcatgagtggcagctgtgatagcacagcttctgaaggagagaaagcaactaaggactgccttgaaaatatttaaggagttatttgagctgctgtgttgcaagttcgcctaattagagtggctactttcctttgtattctcttggcaatgtacagggattccgatgaattggattgagagtaagaggttgacatccaagctccatgtatttttgtgaagttaacattggcaatgatatctggaacttagttcttttctacagttggccatgtgggtttttttatttacatacatttatgaggtacatgtgcaatttgttacatgcgtagtaggtggcagtgttttaaacaatggatttcacctctcctttgaatgcttgtttgagaaaagtaattcaaatcctatctaaataaatacatttatataatcatgacaacttttaaaaacaattataattttctttcactagtactgtgtatgttttgagctactgtgtttaataagctaaggatatatttgaagattttatcagtccacttggcatctcaaacttaatatgtttaaaaacatctcaaacttaatatgttgaaaacatagctcttgaccttgaccccttgtccgcctccaacaagtctttcccaattcagctactggtgacaacatccttttagttgcttagaccaaaaacctcagtgtcctccttgagtcctctcttttcacaccctgtgtccaatccatagcaaatcatgctgaatttacctttagaatatatatgagtttgaggcatttcttacctgctccacgggttcacgccattctcctgcctcagcctcccgagtagctgggactacaggcacccgccaccacgccaggctaattttttgtatttttagcagagagacggtttcaccgtgttagccaggatggtcttgatctcctgacctcgtgatctgtcagtccccgcctcccaaagtgctgggattacaggcatgagccaccgcgcccagcccaccaacacttcttacctgaatgttggcagcagcctcctaactggtctccctcctctgtcttgtacccctttagtctattttcaatgcagtagccaggtgaatccctttaacctagagcagtttatatcaccactcatgtcacaagtgctcaagcccttcacctctttcaagtaaatggcagttatcccaacgtccaaccaggccaagcactgtagcctcatgttacctctcctacccgttccctgatagctacttttccccctcctctgttccagccacattggcctctgctgtcctctgacaccccaggcatgctcctgccttgccctttgcacttgctcttccctctgcccagaacacaatctctctaaattgctcgtggcttactctcggagctccttcagactttcttcaaatgccagcttctcagtgaggccttcctggctgctgtccttgagctctccactgctctactctgctttatttttctccaaagtataatacttaccattatatgttatttattaattttatgttgtgtctgttttcccagaatatatgtattgcaagaagtcagggatttttgtctgttttactaaagattgtacccctagtacccagaacaatgtctggcacctaatagggactcaacaaaacttgctaaacatctattaacccaaaagttatttaatttattatatttaatggcaggtattgtattgagcagtagagtactatgtactgttaatcttgctaaaatatacttaaatatatcattttaatttagggagggggatatgacatcatttctgctctctcactagaattttaggtacatgatgatgtttaaacaaatttgcccaaaaaaaccaaattctatttcagagataaagccattgtttatacaattattatacttatagtagctatttttttaacttcaacttttctcttctgtctttcttgtttttgttttccagaaaagaggcacagttagatgaagaaggacagtttcttgtcagaataatatatgatgactccaaaacttatgatttggttgctgctgcaagcaaagtcctcagtaagttgaatgcaactttccttctttggccaagttacacgtagaagctcacagaatgcatggttcaagatcacaacgcagggttacagaagtggtgcagagcatttgtacaacctgcatagttgtgtggtgggcatccacatatcatgttaggctcaggctatgccaagtcttatttttccttttgcaaattctttagagaatagaaaagagtaaatgtgctcttcttgttgttttttgagacagggtctggctctgtcacccaggctgcactgcagtagtggcccaactccggctcactgcatcctctgcctgccaggctcaagtgatcctcccatctcagcctcccaagtaactgggactacaggcacgcaccaccacgcccagctaattttttgtatctttggtagagacgaggtttcatcatgttgtccaggttggtcttgaactcctgagctcaagtgatctacctggctcagcctccgaaagtgctgtgattgcaggtgtgagcctccacgccaggcccagtcctttgtctcccccaacagaaagccatgtattcaggaaggaaagagaattattgatacttaatgtaacaacatcagttgtggtgtcaagaaaacggtagttattcaagtataatatgtgtttctccaaatctcttttgtagtcacaagttatattaactattggtaaaagaaacatgaaactgagatctaccacagataaatatctttctgaagaaggcaaagttttaaaaatttcatggagaagaagttgttctcaaagtagtatctattattcccacagtgcttaatttttaactgggctatagtttggatacaatagaatgaagcttttagctttgccacatataactaggaaagcaaacactatctatagtagaataaaaattgttttaaaagattggtaaatgtttaatattaacaagaaaaatatctagcctccagcaatcaaaattgaaacaaacatgaaataactttttttattatcaatttggcagtcttaaaaatggaaatatctagtgtaatgatggagtacagttaatgggaaatcacatacattttaaatgtgatggtagttaagacaacttttttgagaacaattttgcctcatgaaagccttttaaaaaaatattaaaaccttcagtaatttttcctaaataaattattagatctctttccattaagatttatgtatgtgttttcatgtcagagttccatatattatcaaaaactgaaaaaaagcctacattttcaataagaagggattggttaaataaattattgcatccatatgttgaataagatagcaattaaaactgatacacagcactttgagaggccgaggtgggtggatcacttgaggccaagagttcgagaccatcctggccaacatggtgaaaccccctctctactaaaaatacaaaaattatccaggtgtggtggtgggttcctgtggtcccagctactcaggaggctgaggcaggagaatggcctgaacccgggaggtggaggttgcagcgagccgagatcctaccagtgcactacagcctgggcgacaaagtgagactctgtctcaaaaaactaaaaaaaatgtgatacagaaaatttaagttttaggaaatattaatgattgtttattaagaaaaaagcaggacaccagggtacatgttatatgtaatcaagttattaaatatacatatttatataaagacttttgtatcaaaatattgtcatgtgcattcttgatgattttaaaaatctgtgttttttggaaaaaagaagtagtatatcaaatatatgctttaaaatggccaaaattaagtacagggtgagtatctcttgtctaaaactcttgagaccagaagtgtttaggctttcagattttttttggattttggaatacttgcatatccataagaagatatcttgaggatgggattcaagtcgaaacataaaattcacttatgtttcatgtacaccttatagacataggctgaaggcaattttgcacaatattttaaatgattttctgcatgaaacaacattttgactgcaatccattacacgagttcaggtgtagaattttccacttgtagtgtcacgttggtgaccaaaaagtttcaggttcttgagtatttagaatttcagattttcagattaggtatgctccacttataatttgtaatagaagctgaaaaactggttgctttgcttgtaaatgcaaatgtacaccattaacatgtttatacgttgtcttctctgatttcattgtattgtcctggcgggatttttttcatatgatctatgcttgccatgcacaaaaattgaagacattttacattacttaataaacacttatcttcattttttctattaacaatatttcacctattatatgctttttttcccctcttgaatttgtaaaatagatctcaatgctggagaaatcctccaaatgtttgggaagatgtttttcgtcttttgccaagaatctggttatgatacaatcttgcgtgtcctgggctctaatgtcagagaatttctacaggtaagcaatttgaggtcctatagttaaaagttctgtgtttataactctcaaatatagactctagaatacttttgttcactcagctgtacaagagtgtcttgcttctgaaatggaatcgtagtcacctttttctaattcacataaaatcatcgttattggagcgtctcgaatacattttagcattatattttttctttaacttctggttgctgatactgaatatgcaagttgtaaattaatgttccctgaagaactccaggtggtcttttgtgatctgttcaactgccctttttttggggtaatggctctatatcctagtgattgtggttttatgtgttagacatttaatatggccttattttctatttacaaaacattcctagtttgtagatataatcgagcaatgtatcagtatttatgaagttctacctggagctcaatgtttaggaaaaagtagtagggttttcaggtgttctgtcaccaaaacatacttaagatccattatcattagttaaatattaattaatctactgtacgagggaaaataggaaacagtccaaagtcagtttcaggtgaaaaagttaaataatgcaatcacaggcctttgtcttacattcttgttaaaattaccttaaaagattgtactagtaaattacacattagatgagagactatttctggattgactatactattttaagcattgacatttgtgagaccctcttcttgaaatgtgttaacattgaaaattatatagttgtttgcaaaggatatttctaaactggctgctttcagcagccagatcttgctggaaaatgatgtcagtgcaatactagctgaaccgaagcccagttttgagggaatgtaaactactttcaatccagctgcattattgatttaacagccaaaataagaactttagtgtttaatcaaaatgtctgttgtttacatagtgacatttttcttataaacttaaaacagcattaaatcaagttggaaactggtttgcaatctcctgccatggatttactaaactactggtgtcaaaaaaagctgccacttccaaatgaagtagctgccaagagatatttaaataaaattgaacaggcagcatttaatgggattattttaaatggattaaaatttgatacttaaatgttttgggggattttgggtttttgaatacatatttcactttttagtacttttgttggccactatcaacttatagcaaagtttcaactttcagttgttctgacttataactctctctctcaatgcccatgtttacataacaaaacaaagattcaagtggttttattaattccttttttttttttttaacctctactcattgtgaccatctgctaagcttgttatggcacagtaagagagcaagcggccttttaggtgtgtttctctgtattccagagctgctttatccaataggacagccactagtgcatgaggctactcagcatttaaaatgagatgtgcaaactggggagtggctcacacctgtagtcccagctacttggaggctgagatgggaggatcacttgagcctgggagatggaggctgcagtgagtgagctgtgatcacatcactgcactccagcctgggtgacagagtgagaccctgtctctacatacatacatacatgtgtacatacatacatacacacaacaaagtgcaatgtgctgcaagtgtaaaatatacaccagatgtcaaagacagtacaaaaagaataaaagatggctcattcacaattttatattgattgatttcatgttaaaatgttaatattttggatatatttggttatataaaatgtagttaacatagctttaaattatacacaattttattttatttctctttcaacgtgagagtgaaaaatgaagaaactagaaagttagaatactgtagttttcatcaatattttacattatgattcagttcttttattttctcctggttttgaaattatacattttaagggcaaattgaatatgttaaaatactgcttttctaaaaagtagatatttatgttatcattaggctgattacacagaaattaaatggactttttctgtgtgactataaaacaaaatcattaactttcatacattgttttaacatgccagcacacatatattgacatttttattacgtaaattagtaaaatattctttatggtgacttcaactcttcactaaaaatttaaagactttctttctgtttcagtcctggttttaatcagtcacagcatctttagattctatttcccaaatactgagctttgggaattctgccacttttctctatttccccccacacttctttgggagagtctaccattatctagaggttgaatggattccctgcttctcttcatgactcctccaatctcttctccatcctataactctagtgctttttctgaaatgcaaatgtctctcgtcgtatcgttttcttgcttaaactctggagtaattttttattgctcactggaaactgtcaaaatatttaaaacaattgaaacctacatcctttctgcatctttcctctccctctcccccagtccagccaaacttaacctctttaagaaccttgtatttatcttgttcccgctatcctctcagcttttccactgctcttctctttgcctggagcatgtttccagcactttccccatagataaattctattaattctgcaggtaaaattacttctctgggaagacgccactcctctctccaagctctgccctatcctagtcacggtaactaacctctctcttattttcataggacactctatttccccagccacagtagttttcatactgcattatcattcccatttgatggactggaatgtaaacttcaggaagccagagatcatgtataatctcttaatgtttgtaccttcacagatgcaatctgtatatctgagaataaatgaatatcttttttaaaaaagtgaatatttgttgtttgtgcaaaagcagaaaacacacaataggaagcaaacacaccaatagatcaagctgaattatttgcctcaggataacccatttcgagtgagatcctgtaattttttttacggatgaatcatagattgaaatataaaagaagagacatacactagaccaatttccttttcaggtgaacatcctaaattactgtttattatttaatttacagggtacattgcttgtatctgttgacacttttaaaatggtcgttctgacatttccattttaagcttttagggaacactaaaatagctactgaaatcataacatgggagactatttgattatgccttagctgagcaactctgactcactcatcatagcaagcagaatttccttggaagttgcctgtccacagcctctcagttagatacattattaagaataggtctgtcttatatatgtatatacataccataccattgtttttacttttcttgaaataatgaaagaaaatttctaagtactagacacagcatataataggcaattaatgaaacagtctttaaataatagaattaattaattctgaagtatatgtgtctttataattatttggtccagcctgttttatcaggataatacctcttttgcttaaattttttattcgaggatactgtatagataatatctgtagcttagctccagaaaaatatttgttttctcacatggaggttatcatttccattcacagttgacttaacgaatactaacatatctttccccttgaaaggctttggtgccaatatccaattcatgaccctgcttatgcagtctctcctgtgcttacaaattcaagtttaaaaaatttgcattatgcgtattttaagccacactgagactttaacaaaaaaatagctagaagtcctaaatggataaataaaatataatgggatatatttaggataaataaaatttaggataaataatatttaggatatatttacgataaataaaatttatcctaaatggataaataaaatataaaatttaatggataataaaatataagaaatatttttagagaaaactttgtagaaatactcctcttctctaggcatttcacagtttagaattgattttttcttaaatcaccagtgaaagcatcaacttgtgggctgatgaaaaaagtaataatctttggcatttattctttggttgatttaataattgaaaatataatgtatcaaaaagagaaaaagaagacatttttaaaatttgatttttggatcttatatattttacctgggtatattgttttaaagacaagaccatatttcagtaagaattttgtctagtttttccacttttttattcataaattgacaataaaatgtgtggttccatgctattgctatagtcaatgtctttttttgcgttttttaatgttttattattattattattattgagacggagtcttgctctgtcgcccaggctggagtgcagtggcgcagtctcggctcactgcaaactccgcctcccgggttcacgccattctactgcctcagccgcccgagtagctgggactacaggcgcccgccaccacacccagctgatttctttttcttttattttgtattttttagtagagagggggtttcaccgtgttagccagaatggtctcgatctcctgacctcgtgatccgcccgcctcggcctcccaaagtgctgggattacaggcatgggccagagcgcctggctgctatagtcaatttctatctgaagcttctagtgtactgatgaaaagactgcaaagaatacatgggatttgaaagcttcataagaaaatagctgataaggaatgttcagtttaatgttatttctaccttaatccacgctcacctctactctctaatgtcctattgcattatggcacattctattttccctaaattactgcaacagtctctcccatctcacatgcatttctgtagtatgattttgcctcttccttgcgggaggtaaaattctcttttccttgaatctgggttggctttagtgactatttaaccaatcgaatggggcagaagtgagatatttaaacttcctaggctagagtacaggaagtcttggtttccttcagggtatcttggaacagttgctgttgcgatggtacctctagaaacccagacacatgaaatgagaagcacaagccacatggagaggccacgtgtagactggcagatagcagttctagctgggctctcagcaaagagctggaaataactaccagccatttgattgatccatcttggaaaaccagcctgctccggcattctgataatttcagcccagtttccatctgattccgtcccaagggtagaactttctaatttagccagacaacccacagaaccatgaaaaataacaaataaattattaaagttgtttgacatacagctatggataactagaccactactctgtgcattatttttccctttatattttatgtctgtgttaatatgtgtgtatatgcttgtacaatgagtcaagagctttgagaaagctgtatttgataagataatctattacccctgggaataggagccatgtcagtcccaaacagggctaccaattcaatttcgatggtattacattattattacattatattgtttttacctcccctacaaatttacagagttaaaatgcaattaaaatgagcagcgaaggctgccaggttgactatgaaaatatacgtgggcaaatgcaattttagagaacagttaggatttaaattatgacctaatttaaattagaactcaggtgaatagttagatcagcgttctttcattatttgctggagacactggcttcttcaactaaccttgatatgttgacagtttcagtcattcactcaactcagatatatttgagtttatcaactagcgcctctgttcagcctgccatgggattttcttcaattcctgttggctccaggttttgacttattaaatacaacattgtgatttggccaccaggaacaatctgagattgatgactgatctaattcttaaatgtttgtgcaaagggttattttaggaaatatgaggattttcctgaacagctgtaaaattctaatacttccctaaattatttatatttcttaagaaaaaagagcaccattcactttatttttaactttggaattttaaaaaagagctgttttctcagcatccacaacgccaatttctataatccaataataaaaatagttttattttttaaaaacttatgaaggaagataagaagtattccagaattgtaaggcttttcagtttgaataactggtatatattttcataatttttcaaaatattgattaattgttacatgtagtattatatagactggatcttttttaacatgagtttaaaagcaatagaataagagaaatattttaactgtttttctttaattaaaatatttccttggagaggatggtaatgataaattgatatagctttaacgctatttccatttaaataattttagtgactctggtacagtttctttttaaatagagattttcaatgtttcttttagaaaagaatctctatatcttttcagttgaaaagctatttaattctcaagaagcagctccaggaagaaaaggcaggaaaagtattatgaaagcattcacttcctactccaatctcatgctatttactttggtgtttctcatcatctagggtttgatgttccattttacttaggtcgactttgtttaaatgttttatcttcaaattccaaaatgacttttttcttataaaacttaacaaaatattttttaaattacatgactctcattaaagaatgttggtgttggtcctatttttcagaggtgtgagggatagaaagaaaggaaatactatacctcatcctccttcattgaaaaacaaaaagaggtttgcaatgactggttttaaagatttcttgcagatctaaactgcagtaatattctcaacacagacaactcccttctccccatccactaaaacaaggattcttggatactgaaaatgtttttctttaaaacgttcaaggcaaggtcttacccatttctgtggatcctttaaaaaatttaattagatgtccttgaaacaggaaaatcaggtagttgacttctggggactttgcccctgtaattatgtaagaacttatttttggcatgcatattacaaaaagaaaatgtgcatttattttgaaacatcccaagatctttaaaaatgtgacactttattactcaaaggaatgataaattgtcttttgttttctaaatctgtgaagtgtactatgtctgaaattccagtagagtaccccagaataccagaactaatttttcttttataaatgataaatgcaaggtgataaaataaactagactgacagggagcagaattcctgagtagaaaaaccacattcatttgcttgtagaaaaacaataaaatgatattagaacattaagaaatgaaattattaaattaaaacctttaggtatctcaagatatcaaaatagatgaatggacctactctctatatttttcctgttttttgattttatgaagcctagaagaatgaatcaaagcatatttcagatttacatcattgtttcctgggaatctacttgtgctgcaatgtaagagtttacattttttcagtgtcttttttactttcatacatatggacatacttctttgcaattggccacacagctctttactttctgtaagtgcttctgtgggtatatttagaaataacacagaatatcagttttgatatgaaactcttattccccagaatacattgttagagcaatgtggatgaactatcatctttgtttagatagcattatcaaatgtagaaagggttttctcttggccattgtaagaatctttttgtagcaaaaaaaaaaaattgtagcctgtatatgaggatgacacatttattagcaatataagtgtacttaaatgaaaataacttttaatcattaatctcatttcttgtaatagtctggctgtggtaattactttaaattttgaaagagtaaagccaagtaaggaaggttgtaactcaagaaatcccaagagtattttttatattagatactatctaaagaaaatcaatattacattaagtggtgttcaatcttttatgattcaggagagcactttacttgttcaattaactaatagtaaattcaataacacagtaaatctctggagagttggttactgcaaaaagacagaaaaggtgaacattctcatttggtgtttttggtatcctttggtgagggtgcagtgcctatctttagtgactcaggaagtactgacttggatgattgtgtccactctctgacttgccccagcataagtggtgccagtgacataagtggtgcaagtcgttattgccttatgccatctgcttgagtgaaagtagaaatgttttaataatccagtaaaaaagatgagtatgaaaatgatataagcacattggtacattgatttatgaaatatgtaagcattctgtatagaaaaaatattaaaatgcctttttgaagttattgtttggttcaatttccttttttttttttttttttttgaggcagaatctcactgtgtcgcccaggctggagtgcagtggtgagatctgggctcactgcaacctccacctcctgggttcaagcgattctcatgcctcagcctcccaagtagctgggactacaggcatgccccaccacgcctggctaatttttgtattttctttctttcttttttttttttttttttttttttttgagatggagtctcactctgtcgcccaggctggagtgcagtggcgagatttcggctcactgcaagctccacctcccgggttcatgccattctcctgcctcagcctcctgagtggctgggattacaggcacccaccgccacaccctgctaatttctttttttttctcttagtagagacggggtttcaccgtgttagccaggatggtcttgatctcctgaccttgtgatccgcccgccttggcctcccaaagtgctgggattacaggtgtgaggcaccgcgcctggccaatttttgtattttcagtagatgtggggtttcaccatgttggccaggctggttctcgaactcctgacctcaagtaatctgcctgcctccgcctcccaaagtgctgggattacaggtgtgagagcacgcctggcctcaatttcttttttaagtgagccaacaacacagtacctgggcctgactctattagaaacattttctaaatgcagccacaagctcaattttgactttgtgagaaatgcagataaaaataaaactctctcagtgattttttttttctcacccgattttctttcacaaaatgtttcacaacataagtagaagtataaggggtctgagagggctatgaagcagttctcaggtcgtcccttctaagggaagagtcctaatgagaatgattcatcattggaagaacctctcatactattcaaccaagtaaaacagttttaggactccggggtttgtaggttatatatacctcttcaatacttagtggctgccatattggattacttttacatggcaatagcagcctctagaggcaatccggatgaactgatgtttttgctaagaattagcttgactccatcaggtataattgtggggaaggaaacagtagatgcagacggttcaaaaagtcaccagatttatcgagttgaggaggtcattgaatcatttatctggattagattgtcaaacttcatgacctagctcaaatcacatcttcagtttgaagtatttttaactccattctttcagtctgaattgttggcttcctcatttgctcatcaaaagccactctacacatccatttgtgatataaaccatgagctgcttaatcctcatcatgcagatctgcatccaaacatctaccctgcacccaagcccacatgacacagtgtatgatatataatgcacatacaataacattatagagtgaatgcatgattgagtggatgtgtggaagggacagaaaattaatgctgtaagtgtcctgttagagtattgctcaaatgtggacacccgcggaatcatctcattctcaccgtagtttcctcccagtaatctcactggatttttctgtttttctaaattgacctctttgagacatttggaatgaaagccatagtttaattttggcatatctccagtactttcattttaggtatgttcttttatgcccatgacattttgaaactgttttgttgtttttcttttcttctctttaaaaataatcaccagttgtgaatagattactacttgcttggtgtatttgttttttattgctaccataacaaatgaccacaaacttaagtgcttaacacaaatttattaccctatggtttcataagttggaagtccattgcaggtcttactggactatattcagcgtgctgtgctggtgggacgggactgtgtttctttatgttggcttttggggataattgttttcttcctcattcaagtattgacagaattcagttccatgcagttatagggctgaggacccagtttccttgactgtcagcaggcagctgccctaaagtcctggagacctctctccagtccttcaacagtctcctacatctcagaaccagtcgcatggtgttgaatccttctcatactcccatctctttgaccttttgtcattgcacatctctctgtcaccatgtagcagggaaagcttcttgacttttaagtgcacagtcacccatgtgactaggttgggctcacctggataatccaggataatcttcccaactcaaggtccataaccctcatcacatctgcaaaatccctttcaccatgcgatacaacatattcacagggattaaggcaagggaatctttcagagacagttgttttttcagcctcgtctgaaatgtgctaagtgctttatatacatgtttaaagttatctccattttgccagaagaaataaagtcttagaaaaattgggcgaattggctaccttcctatgaaatgacagtcattatttaaacccatgtctacttgatcctaagtcatattgctcttaattcctataccatgctgtgctgtgtgtatatcctactatatatgtgcagcacacacacacacaccccaacatgttatgaactgagtgttatttgaaaaatcatcttgggccacataaaatgtatagcttacaccgtttcttctagtactctttacaccaattagttttgtatattagtaatctgagactcagggaaacgtggcatcttccaaactaatggcaaggctacaaaaacagaaaatatttattggccaatttattagttttcctagactttcaaaatgtagttatttcacagattagctatgaaactccaccttgatgatagcatactaaagaacatgaagaaattacattgttttagtttctaaaatagatttttaatttctaagatattagaatagttaaatagaaatcacaaaataatatgcttatgttttatatgcttataatttgggcatagttttttgagttgacaattaagttttagaattgcagtataaacagaagggaaatgtgtgagtcctttggccattccctgttgttgatcacaacacgtagaaacagctgccccaagctcttgtaaatgtatctttgccttagcccttaactatgtttttttctgttttagccatcctttttaatcccacttgtttatcttttcttaaaatgtactaactattcatagctgcagatatttttcttaattctactatcttagtttcattttctctgtggcacttgctttacagatatctcagtggagtgaaggatgtgctacatgtgctgcttcgctgatctgcccactagactccgatttgactcgttttcatatcttgctttcccagagtctgctgtcattgcgaaagcattgtttattggtctccctttcttctttgctgcagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggtaacaaacagcaatggagacttctgaacacagatgacatctaaaaatattttaaatgacactctctaaatttacctgcagttatcactgttagtgctcttccctggaagtatatataagccaaaacagtggaaagaccagcaatcttctatatttggcctgggagtgcattatacaggatatttttttccttctggcagcagatttttctttctaattatatagtgttcaaggctacaagaaatttactttgcattccctgtgaacacacaccagctgggaagcagaaggatatgtgacgactgagctgtgggtttcagcatgcaaaatatccataatatggatagtcaaattctaaggcaatataaaattaagtattattttatagatcattttctctttgtcgatttttgtctgccccgaaatatagttggaatgtctaattttgtgaatgaaagtgtttgtttttgtttttgtttttaatcaagttacttggtgaaagaagccaggtctggtactttaaaaattgtgctgttattgataatacacactcttagttttgagtgatgatttcaaggtactgatagggcaaccgtacaacaaagagaaccactgtttctctttacctctggcccttacggtttctcccagtcaggctgctttttatgtgttcagcatgttcatacccaagagtcaattctcagtagctttaaacttgaggccaaagtggggagatagatacctttttccaacctttctttgtttatagaaaacctattagacagttctttcttatagatcatagatatattgtaacacacttgggaggtctaaaacccttaagtggagtattatccaaaattaaaatagtaacatttaaataaattagaaagatattccacatatttaatctagtaaagttatgttagagttcatggttttctttctttcagaagttggtgttagttcttacgtggcaccttttggtgatttccaggtgcatcgttagttttctacaaccattagtaatggcggaaaccacgattactgttgcaccaacctaatagaaagtaggactgtgtataacatggcattatcaaatgcagacatttaaaaattaaagccttgggtaaagtatcacaattcatccatgattgggaatctcactggtattcaatcaaaatagtatatacctcacatttccaatctttttttttttttgagacagagtctcactctgtctcccaggctggagtgcagtggcgcgatctccgctcactgcaagctccacctcccgggttcacgccattctcctgcctcagcctcccaagtagctgggactacaggcccccaccaccacgcccggctaatttttttgtatttttagtagagacggggtttcaccgtgttagccaggatggtctctctctcctgacctcatgatccgcccggctcggccttccaaagtgctgggattacaggcgtgagccaccgcgcccggccagtcttttgttcttgacattaaactaacagtatcgcctgggcgcagtggctcacgcctgtaatcctagcactttgggaggccaaggcggggggatcacgaggtcaggagattgagaccatcctggctaacacggtgaaaccccgtctctactaaaaatactaaaaaaatagccaggcgtggtggcgggcgcctataatcccagctactcgggaggctgaggcagaagaatcgcttgaacccgggaggcacaggttgcagtgagccgaaatttcgccactgcactccagtctggttgacagggtgagactccattatcaaaaaaatagagaaaaaaaaaaaaataaagcaaaacaaaacgaaaaacaaaaaaaaacacagcatctatactgagtgaacgtatatgcatattgtatgcactgttggttttatttttatttaaccagactgagaaagaggtaggttcgtagaaacttcagaaagaaacacaaattaggacacacttggaaactactattactgtggtattagaatctttggcatgggagattgatggctttagcaaactgtatgaaattcaagtatttacttaattatatggttcactttataaaatatttaaattctcttctgaccatttattcaagtgcttcaatatgaacttctgaaatatttgcattttataggtatattttatgtgtttaattttttcaaaagcactgttttgacttctcgagggattctcacattaagtttatcaggtccagagataccagacaatttgaaccacatggttaatactagatcatgtcataaagtgatataccaatgagaagttaaaaatatgattagaaaagctatttgttttgccagtttgatcaaagcaaaaaaattagaattgaataattaattcataagtttaggatacatataattcaatttctctagttaaatagaaacagagtagaacatcaaaagtaggcctgtcatttaaggttgactctcttgccttgtctatgagttagggaaatcaaccttaatgtggtaaaattttcaaattataaataaggatactaatatttaaccagtatagtaagttattctgacagtgaggtagtaacatcccagttttgctacaaaatatatctaaaagaatatatacaatagcatctatagttattgtgatttgtttttaaaaattgcagagaatgcgacagggtactcctgaaaaaaaaaaaagaaaagaaaaatgaacaacattttgtttttatttagctgtaactgaagaaatgttgtcccaaactttttctgttttgggtctggttgccgttgagatcgagttttccctttgtaagagggctcattgcttgcaatttcttaacccaaaaagaagaggaaaatctatactttaataatgtatttgcctgtgaataatactttagaaaagtaggatttttttacattatagatattagctcacaattacgattacttctttagaatgaattcctagatttgcaattaaatcaaagaatccacaaaattttaaggaatttttatgcctattgtcaatttatccttcagaaagattaatcaaaataccccctcatcagtggtatttgagatgcctctttttcagtaccttacccaatttaatattgtaacttttttttctttttttgagacagagtctcgttctgtcgcccaggctggaatgcaatggcatgatctcgtctcactacaacctctgcctccccaggttcaagcaattctactgcctcagcttcccgagtagctgggattataggcacccaccactgcgcctggctaatttttgtatttttagtagagatggggttttgccatgttggccaggctggtttcaaactcctgacctcaggtgacctgtccgccccaccctcccaaagtgctaggattacaggcgtgagccactgcacctggcctggtattgtaactttatgtatttgatagttgatggttaaaaatgacattgcatttatttttgaatatgaatctctatcattttatttcccattgttttaaaatagtattgtaatcttatttgatagtgctagcttgcttttagctggctttcaggttgttcactatacaagtgtgcttggctaagaaggcagagcccacaagtgctttttttttctaattctaccaaagagaccatataggatactggggaactgataccagatttgtaattttacaatgattattcaatcttcaaattttatagatcaaagtccagaaatattttcctattttagacatatggagtatttgcatatatgttttgaatttttgtaattaatcttctaaatgcagtattcataactcattttttatatttaggtatttttattaaactgaaatgaagacaattcatgccatttccccctttgatatccaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccaggtaaaatgacagcatacttccttggggcctgagacaaaagcccatagaaatactattgttacaggcagccatccattcatttaaccctctgactatgtattaggtaatatgcagtttattgtaagttacacaaattgtttaattgtgaactaagtgtatttgagcataccacaactttccctaggacaactatttttttataataatcacatacagaaacagtaggaatgttatgtaagaatagtatacttgttacagtgaaaaaaaatgggtaactttttagtaacagtcacctttcacatgtttatttattcactgaataaatattcattggatatctaccatctgtaaatagctttaaaaatcaactattgatggtgttaagggaaaaggggggattttaaaaagaactaaaacacaaaatgatagagatgatgatggattcagtagaaaaagcatcaaaggaagcagttgggatgatgatgagaaactgctgttgacttctatgacagatccattggtaaaatcctttatgcttactctttttttcttaaatactaacttttggagttgtatatggcatacgtttagagatactttttgcttgtaattaaagagacttgaaaattcaggattagcccagttggatcaggtgaaatggaagcagagtagtgtgctgtcctggctctggtattgactctacctgtcccttactgtatgaccttgaacttattacttcacttctctcagcctgtttctctttgttctggcatgagaatagaaagcatatgaaaaatacttagttcattgtaagcaatcaatcagtgttacctattgttttcacttttagccctctagataaatattaagagagggtttgctcatgtttttggtattttaatttcatttcaagccatacacatttaacataacactgtacattttaaaagataaattttcattttttctccttctgaaaatgcattgtaaatttatgctagcttacatttgaatattagtcatctgaatccatatcagatttcatgttcttgtaactatttaatgtccatttaatcactgagttgtatagattgagatttgagttgatagttcagctaagtttcccttgaattataataattataattttctagttttaaatataactgagctgatttaatcaagcgattaatatcaaagtataaaaactattttaactgatgtgatactctttgctctctatctatattttagctccagcctgggaattgcagccttctgtctgtcttctcgctggttcgtcctcatattgatattagtttccatgggatcctttctcacatcaatactgtttttgtattgagaagcaaggtaatcaagatattatttcattaaatgtgagaaaggtatgtcacaaattagaagtattcaggggggaaaattatcacattctctgagaaagtatagagagataaaacccagacctcaaaggaagatctatttaaaaggcaataacattgatttttggtttgcctgaggagcagtggaactctatcaactgattaaaattaacagaggtaaattttagagactgtctttctgagacggccttgtttcacatcaaaaaaccaacatcttttactccctgtacagctacagtgccttattttagaaatcagaactaaaaaggatttttttttttggaacttcactcaaaaccacttatttattctttcttaaattgtctattgttcttagtagcgtttttgtgggtgaataaaagtgatgaaatattcacacagttgataatttagatagtgctgggatctcacggtttctgttcttgggatagatacagcaaaagtcattttcctagagtacccattgaatcctttctgtatttggaactgactgtttgcagctgctctatgaatacagggtgggagaatggggaggcttggcttattctttgagagtctggtaatgtatgttggaaccataccggaaaatcagggggataaaaaagattcacaaaagcttgaaataattatgtgaagagtagcacagttactgtcctgaattcagacgggacagtcacttttctgcagtgttgcaaggcagccactaggcttattacaggcagaactctgacagaaggccctctcctgttctaatgatgcacttattctgctttgtggtttggtgggaaatgagatatgcgtgtccttgttgctgaattcttaggtagggagaaaggcattcattaatggttgtatcttgccttttcaaggaaggattgttggatgtggagaaattagaatgtgaggatgaactgactgggactgagatcagctgcttacgtctcaagggtcaaatgatctacttacctgaagcagatagcatactttttctatgttcaccaaggtaatcatttttagattaattatagtggctatcagtacctatctttagctaacaaaggaatgccacaatattttattccattaaatttacatattctctgaggtgtaattagattttacagcccttgttgtgtattactttataacaaggataatcttatttaatatttgctaataaactcagaagaaatcacatactctatgttatttgccatgtcttaatacatttgtggagtgtttatgccattacgccatgggacaaataatctgcattaagctaattctatagttttggaccttcaaaataggcattatgtagaaaagtgattttttaaagcagctaataggatggcataataaatacattggtatatttgacatcaaaaattatcttttctatagtatgttagcaaaaaatctaaaaggtctctttctgggtttgaactattttaaattaaaaatatttacctactctaatccaaatacactgttccaaatatattattcaattaaaatgtatgtaaaatgtgatttttaataaacgtcagagaaaaataaaactatagattgttgttttccaatttaggaaagcattttactaggagatacatgggaattcagaaatataaaaattatgtctaaatttgcttcagaacaatagaaaagataactgtggggattattgtgagatgatattctgtgtattcataattttgtataaacaaagtgtaggtgcattatgtagtaacacagtcaagaaggcatgttttggtgagctattggttaaaaatttaatctgaattccaccatgatcacttttcacttaaaaatgtggtcttaaaatttctgaaaaatgtaatacactttgtaacaacctcctgttatattattactattgtattatacattacataacaataatatataaggccaaataagaataatatattgttggcacagtagttcacacctgtaatcccagcactttcggaggccgaggtgggtggatcacaaggtcaggagttcaagatcagcctggcaaacatggtgaaatcccatctctactaaaaatacaaaaattagccaggagtggtggtgggcacctgtaattgcagctactagggaggctgaggcaggagagtcgcttgaacctgggaggcagaggttgcagtgagccgagatcatgccactgcactcctgggcaacagagcaagacactgtctcaaaataataataataataataataataatatatcgttaatttttaagtacatttaagattaattaaatattatttaactatgacatataagaataatatatcagataatataaggatatggatgtcttttccctgagaaataaatatcaggaaaataaaagaaacaaaactaagaaacataaacgctttttaaaaaaattattaagctacattgatctaaagatgtcccatctgctatcagtaagtgttttcttcttctgcctcttcacaggttgagcttaggagaatgtcagcttctcattaggggcaatttctatttatggaaagaaaggttttcttcagaaataaaagcagaaaatttggagtttatttgttaattcccatatgcagacattggtcacccagtgagaaaattgcagattgtcctatgagacatgctcaggtgtgtaggaagatttgtactcacactacataaacaaagatcaagtaaaagtagttttacttgtaaaataattctaagatgattagtttgaatttagaaaaaacttaatggttcattaaaataatgatatagggcatttttagaaccacgagaccgttatgatttaagttttgtaactcagtatgagcatttttgaccattcatttttgaacgtacaatcatgttttttctctgctcatgggcaggtctcgtatacctttggccgatgatctggcttctttctagatgtgtctttttctgcaagtggatttacatatccattttaacgaaattaaaagacaccgtgtatttcattagtaaaatctttgattgttttattttctttataggtatgctaatttttgttttgctttatgaacattgctgctgagaatatattgcattaatccaaaattctgcaaagtcaccccttttaaagaattttggataggattaattcaaaattcttcaaattattaatcccagattctccaaagacataactaaattttttccttttagagtaattattattcagagtggccagaagtaatgactttgcattaaaaaaattcaagccaaagatataaccttatgccattttaaccagttaggttttgttgtcgttgttgttgttgtttgagatggagtctcgctctgtcacccagactggaatgcagtggcatgatctcagctcactgcagcctcctgctcccgggttcaagcaattctcctgcctcagcctcccgagtagctgggactacaggcgctagccaccacacccagctcatttttgtatttttggtagagacgcgtttcaccatgttagccaggctgatcttgaactcctggcctcaagtggtctgcccacctcgcctcccaaagtcctaggattacagatgtgagccactgtgcccagcctcaaagagtacatttttaaaaagcagttaactttttacttgtcagattatcactaaaataataaacattattatgttgttggaaaaatgacacaagttacaatgatgacgcataaaattcagcaggattgaataatgtttcaaataaatgagaaaaatttgtcaaagtaaaaagaagacatgagagccagaagtaagaatgacacatagttttagatacataaattacatgctgaggctgggtcataaacgtggttgggaatttttactcattgtttccaaaagggaaaaataagcagttacaagattcatagaatacagaaagcaaaatgaaagtttctcaaaagaagcattattattcttgagagagagaataaagatagatttttttcctctccttatgatgagaaaaaatttgagaataataaattacagcctgtgttaaatacctcaacgtttatcatagagatgttttctacatgatcgtttcaatttagactgatggcaccaaaaagtgcaacctggcaaaaatgcatctcaagttcactgctttttggtagatgcttaaatatctaagagaataaactcacaatcttcgttcaattctccataattctattgtcttcagcctgatgttttgaatggtaggaggtggcaggatcagattccttgacagaaatcgggattgcattgtcatgtatataagttgagactgatcttgcctcatttctccatatgacagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacgtaagaatgtaacgcttggagcactactgttattcataacataatgtgactctactatatttaagtttgagaaccagactaaaaagccatgtgacctgtaatagctctggtgtagtaaataaaatctttcacattgcttttaaaaagaaattatgcttaaggaaataaaccagtcttaatggtggtggaaatatgtctgctatttttagaagccaagttggaataatataggccaaaatatcttttggaaaatcatgagaataactcaaattcaaatttagttcaaaaattgaagtttaactatcatttattcctgcattctttcatacaagagttatatattgaccatcttcagtatgctgggggctgccgcgtgcagagagctgctctgcacaatgaacttaaccactggccattacatgtttaaaaatttattttctgggaccttgaatttaggattagaaagaaatgaatctgacaaattgtaatattatatgtaatgacaacaattacatctatagtgacatacattagcaaaaatatcaaaatataaaacatttctatgagtggtggattcaattatgaaatattgagcaaggacatgaaagataatacttgattttcaagaaatgtatttaagtaagtacatagcatgcatactacttggccttgctttcatatgctaattaaacgcacatcactgacatttataagctattttacccaggttcttatgtgttcgttttttaatgtttatataaacatttggcggagcttctaagaccttaggactaacgttcaaagtcacatgggtttgtaggtttgagttactcaatattctgttctggctgtttgtattagaaaatcatctaggtttcattttttttgtattgtgactcaatttgctaatatctacattcatgataaatagataaataaccagcactataaataacatagcctttaaattatgacatatgcagatattctgtactgaaaaagctcttaattcacttcttttcctaaattgtcagcttaagcagagtattagcttctcttcctagaccaggagtccaaaactgggagttgctgggagttaaacagcggccttgtctttaatacgagtagctgataagtacttattacagaactacttctttgtttggattccccaaggtgggtttcacattcaggaactatttgcaccatttcgagttactgtgcttcaaaaatccttatattattttttagattattagatttagaatttggtttttgtagatatttgggtttcaaggtgatgtcattagaaaccatttactattaattttctttaaagctaagtagttttactgttcatacttactattcaaatatagctttaatatttcataaaacattcaatgtttaaaagttgaaaatgaaagaccggagaaattctactatgactaggaaaaacattgagagctcagctccattttgcatatttaaacttcccacatatgcccttttgctttagagcaaaaggcaggaagaaaaaggcaggaaggcttcatttgttcctcttcagtcttccaatccagagcccataggtctagtttctgcttctttccctctaaattcaccagctgtcatcctcctcctgtgtgctcacatttgtcccttagcatgatcccatagtagtctcagttgtacctaaagaaatacaataatttattttctagaccaacttcctctggttttatcagtttcttctatggaggagtgaggcatgaatgagactggagagaaattctgcttcttttaatattacttaccaaaaatagagacatatttcttattctaagaggcaaacctgtttccattattgtgctattcataccatgttttaggtgctggtaatgacagtcttcatactgtgactatcgtaatagcagggtcagaatacaggactacaaatgaaaactttgattttctattaccagtctttttgttttgtctgtttgcttggcttattttgatttggtttgaactagtttgggcttgcggatgtcttatgtgattaggatgaacaaataatttatgttttctgtaaatccttgcttataaatacagctaatatttgatgctaattttagaggatgtcctgctagaatccaggcctttaaagtacaaacgacactgatgctgtgtgaaaaggacagcagaagcactaaaggctttcccagtatttcttacagtggctttctgctgatcccactgaacagattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggcaagtgttctttatcgctgactgcagagctatccagaggctggcgttctgagactcccctccagaggccatgtcatcacagctctctgactccagcactgcagccttgagtacagtgagcctccatgtattcactctttaccatgttcttaaataattgcctcttgttataaaactgtctcttccttgtaaccacaatgaatgtttcatgaagtgggtgattccctggttaaaatgaaatgttcaccatcttatttgcacttaggctaacaaatctggacaggctgtttatcacatgtagtataaacatagcattcattttagtcctctgcaagagacatttttactgagatatataaatgctttgtacagtaaagaagtcatgaagcatgagaaggactcagatttgcgtttagataacatcaacttgaagaagataaacatttataaggcgtttttgccctttgtttcatttagaaataaatataatattggaaaaaagaagtcagtggaatattgctacataaaggcaagaatgttaagtaaaccatctctagatatctggggtaatataactacacaaggactatttattttatagtcattttctgaggtacactctagcatgtggtgagcacatcatacaaacaaatgattaatgaccgtgataaatcactgaacttgaaatggtggctctccatgccgtcaagccatcactgttttaggtagaaatgtaaaaaattattcttctgaattataaagttatctgaggtgagaaattaattgcttactaaaggaaaaataattctatgtctgtacctgcccgtcatcaaagaccccaagtgtccatcatgtgtgtaaattataagtaattgcaaggtttcattttgttggagttgaatatattagaattttaagagaattaaagggggagggaagcttaaagttgctggtagacttgaaaaaatatgttttttgttagggtaataaatgaaacagtcttttttatgctaaccgtgaacatctaaatatatgtactgttaggtggagactgttggtgacaagtatatgacagtgagtggtttaccagagccatgcattcaccatgcacgatccatctgccacctggccttggacatgatggaaattgctggccaggttcaagtagatggtgaatctgttcaggttagtaaatgaagtagatattgtaataatggtatgtaaacctttttggacaattgattcatatcgttgtccggaaaatcattaacgtgtataaagaagggcatcttgacaacaaagactatagcatttcatccagcccactgtactacattctttcatagacatggagatttatctacctgtttgaaattatctagtccgtttcatgtactgaaagtcatggggatgagaaaaaaacctcttgtaccttctagtttattttttaaaacctctttcatgtctcatgtaagttactagattcacatctttgaaatcttcagacttcaaatgtttctcttgagataggatatttccctggggagatagagatttcatggagggcttttgaagttgtccataatatgcttgaaattcttatagacatctcttacgatgttatatgatgactctacattattctgtaatataaagtaagcaaaaattcatgtgttacaggaacagaaaaccaaacaccacatgttctcactcataagttggagctgaacaatgagaacacatggacacaaggaggggaacatcacacaccgggacctgttgggagtttgggggcaaggggagggagagcattaggacaaatacctaatacgtgcggggcttaaaacctagataatgggttgataggtgcagcaaaccaccatggcacatatatacctatgtaacaaacctgcaccttctgcacctgtatgccagaacttaaagtaaaataaaaaaaaaaaaattcatgtgttagtgatcaaaatgattgaagcaaagctttcttttttgcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacaggtgagagaaaatgtcttggtatttactgatttgcaaagaaaatgtgtctttgcatgtggtttaattctctgagagattttgttgctttaacagagttatcaccttcactcttccccactgcttgtagagttgtttactttttatttgagaagattgtgtcattatttccattttatatgatttcacatcatcttaggaaatcctgatatgatcattgtttctaaagctttgagttacctttcagtacaacttcagcatttgttcttgccatcttggtttataacatgatacatgtcaccttctctataaaacttgtgtatacttctctctctactccccttcccttgtcttttagatgtcttatgtctccagaaaattcagatccacaattccacttggagcacagaggcccagtgtccatgaagggcaaaaaagaaccaatgcaagtttggtttctatccagaaaaaatacaggaacagaggtatgactaatcaaagtgtaatttgcgtacttaagacagagtataagtatggaaaactaaagcaaaatcactgaaaatgtatttcatttgaaaagaattcttgctaacagaaattaacttctaagtaaagcagtggaaataattgaacattaatgagccaattacaatcataagtactttttaggggatactttagtgatttttgtcctctaatgaaatgaaaaccaacagactggattgagaaggctgctttttttcttgctgttgtggttgttttgctcttcctctgtagtctggctcaaaggtaagtgggctgtgaggggctcccctgacccctttcctcagctctctaagttggctctgagatcaccacagataagggctgtggttcatgggaggtttcttaaccatgaagcttaagatccttttaaggggcaggctatctttctatggagtgattggggaattttggaaatcctagtccctcatgtgtttctcctagatagatgagtgatttttaacttgctagaatctgattaattccttagggaagatttaagttctttctactactatggttatactccaggcagagcccatgtgctagaatggacttcagaacagtggcacatccaaagtggaatcacacctctcatagaggccttgcacacactaagatcatggctagcctcttcctagccttttgtaaggagtggcatcagaagcaagtttgatactttgttaccctgttgatgtgttgtttcctcatgggggataagactgcatgctcatatttctcttttagtgtgtataaactctctaaagatgcttttagggcataacaacttctaaagggaatagaatgccagggtttgaaatatttatcttctttcacctggtttaacattaaatcattttcctatgaggtggacatgcttattgatgttcttctgataaactaagccgtaattacctcaaacattggtcatcttagtcgtgcggtcctgtttttcccagaattatggtgggaatgatttacagaaactgtagatgtgaacgtggatcacactctcataaagagaaaaatatatttaattgatattataaacctcactatcactgtaaatcaatccctcttttcttctgcctatttaaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgtctctatacagtttttatttcaataaaaatattaacattatttttcatttt

SEQ ID NO: 118 - DNA, 930229 bp, Homo sapiens
atgtggggagctttccttctctatgtttccatgaagatgggaggtgagtctcaatctaatagtaaatgctgctaggaattttcaaaacaatttcctttcagctaaattattgcaaattttgacatttgtaatgagagtatttcctgaatatgcattttcctaacgtggtgctaattgtcctcctgttactattgctgctgctgttactgcaaccatttatttcagtctaagaaattctcccatcaatggcagttcttttgtgaccacatggaagcatcatttaaaaaattattccaatagtttttggaggaaacatcatttttaataatgatggggcttctgggggtgctgccctagtaacaatcatgtatcttgtcataggcactgcaggacaaagccttgagcagccctctgaagtgacagctgtggaaggagccattgtccagataaactgcacgtaccagacatctgggttttatgggctgtcctggtaccagcaacatgatggcggagcacccacatttctttcttacaatgctctggatggtttggaggagacaggtcgtttttcttcattccttagtcgctctgatagttatggttacctccttctacaggagctccagatgaaagactctgcctcttacttctgcgctgtgagagacacagtgactatgaggcctccttaactgtgccaaaattcaaaagacaatcagtggagtacaggtgggcttgagaagttctagaacttcctgagtgtatctttgcttaccgtctaattttaaacttgtttagaatatgtagcatagggctctgagacggaaccccattattttctgaaccattgattgctaaagagaaggataaactattttctctctctctttcttctttagtttcttcttttcctcttcctcctgcttatttatgcctccagtatcctgtggttccacgtatggaagatggaatttacttttggaggaagctttttatacaagggaaggatcccttggtgagtgctttagtttatgcagtagtaagttacattaatattcatgtatccttgggaggctctgaaatttgtgaagtaaatgcaaattcctcagcttgagatagtatgatttcatttaattatgtcaaatatatcctcatttttgtatttacctgagtgataatgttgatattatttagcattttttggtggatttatccaacatattggagagtgtgggggctgtggacttagagggtgaagagaagatcatggagagctcttctctgtgaaacagaagagtgaggtcatgcgatgaggtgggggtcaagtgtggaaggaattggtcagtagggaattcctgtaaaagcactggataatggacagaacagtaatataaaatattcagtttaaagattttcttttactgaattgtaatttttgtgtgctatcctaaatgtttttgaagtttgttaaacattacagcctacatagtttgtccttagagggcaatgcagaatttcttccccataggtgaattattttttggcttagtacatttatgtatgtatgtatgtatgtatgtatgtatgtatgtatgtatgtatgatggagtctcgctctgtcacccaggctggagtgcagtggcccaatctcggctcactgcaagctccgcctcctggattcacgccattctcctgcctcagcctcctgagtagctgggcctacaggcatcggccaccacgcctggctaattttttctatttttagtagaaagggagttttaccgtattagccaggatggtcttggtctcctgacctcatgatccaccagcctcggcctcccaaagtgctgggattacaggcgtgagccactgcgccgacctctattagctaatttttaatgacttattttggggtaaacagaataagagggacttggtggtagggagtagaaaggtagagtggatggttttcactcaacaaatattttactgaatacttatatgtgctaggcactctttcaattgctatggtgcatcactaaataaaacatacctgcactgaggttgcttatgttcttgtgaagagagagagtaagtagatgttttagcagactttgaaagcacagggaaaatacatttgaccctcagaactcagcttcattttctttaataggaagagagctgagatgtatgtaagcaatgctgatgtcctgtgcttgttataattttataatataaattaatcatcagctgaataagggctgtataacattggatagttataagactgcaagtcaagttatccaaagaatctcagtctttcaaattattcaaatgtagctgtgtctatagtgggactctatataaaatcagaaagatactgaacgtttgaatggagaatctaacactgaggcaaatgacctttaacatgtgagttatttgtaaaaatgaaaaaaatttcgagtgcttcattgaaatcaagaaggagataaagtctaaaaaactttcagcaaggagtgaatggtcaatggaaatgaactatacaaaatcaattatcttaaatttgaagacgtgtaagttactgatattctccttaatcagtatgctatctttttatctttttaatttagtgaccatgaagagtatccgtaagaacttttataggttcattttgaccttgttttcatatctattttctcctaaagtcttaatttttttttttgagatggagtctcactctgtcgcctaggctggagtgcagaggtgctatcttggctcactgcaacctctgcctcccaggttcaagtgattctcatgcctcagcctcccaagtagctgggattacaggtatgccaccatgcctggctaacttttgtatttttagtagagatggggtttcaccatgttggccaggctgatctcgaactcctgacctcaagtgatccacccaccttggcctcccaaagtgttggaactataggcatgagccaccatgcccagccaagccttaagtttttagataacatgtttttctgccacagagattttcaagaagaaagagtaccattctttgttactttctctctctgctagtagagtttctctttaacccagcaacttctttcatttccacctagaaggtggttgaatgctagatgttggagcaagccattaccagaggataggagacaaggtttttcgaattattgtagatcaaactgggaacccagctctcttgtcatgttcaaagagcagtagctgtgtttggacttcggagttagatatttctaagttcaaatccaagcttcacagggtgttcagataaaatctcacagaatgaaagaaacataggaaggattggaaggaatttgacatgtatcaaatctaactatcttctacaatgtttgagtaaagctctgatttttgagcatctctttgaccttgttttcttgagtagttggggatgagtccagcttcaatgtctcttgccttgagatcttacctttggagctttttatatccctcagttcgggcaagatagaacatcccattgtccagttattttctagtcctgtggtatctgtggagtttccagagccacactggtgctcggatgtctggagcatgttctcactgtggaaattaacctcgctttagttctagttcctaaggaagataaccaagagaacacaggtggaagaagcttgcatcaagaagactacactctatcttggaggtgaactgttcactattacatacataactcaggaaaacttagatacctctcttgtttcttttggcttaatggtggtaaataatttaggtgttactgagccctaggttattcaattgtttcttgtggtttctctactcccatatctttgtacatagttcctatgcagagaaaactctccgcaaattatcatgttttgagtaggctatctattgctttttggaaaatcagcaccatccatgtgccttaagagtgatttgcacatgtactcaggggtacagggaagtgaaggaggtcagttggaagaaatacaaaaaccaagatcttcattaagaagagtttaaaaattttgaaggaatagttggatctttttctaagaaaaatccttaagagatttgataatatgaatttggatgggaaataaggagtgtgctgtgtaccactggatttaggacatgagcgctggaggcccagaatgcacacataacccttctcaggcaacccttgaggctgtggtttggatactgaaccaagggtaaaggcacagacaaaagctgacattttgagggatcagtttatgaggtggagtaaaactctaagctggactctgccagtacccttttgaaaccctgtcttttttcctaaatgaggaatctcaattccagatagaaaatgaggacgaatggctcacgcctgtaatcccagcactttgggaggccgagatgggcagataacaaggtcaggagtttgagaccagcctggccaatatggtgaaaccccgtttctactaaaaacacagaaattagctgggcgtggtggcgtgcacctgtaatcccacgtacttgggaggttgaggctggagaatcgcttgaacctgggaggtggaggttgcagtgagctgagatggtgccactacactccagcctgggcaacagagtgagactctatctaaaaaaaaaaaaaaaagaaaatgaggacgaaacacagccttggttgaatgttctgccaggcagtgttctgtgtggcttttgagcaagtgcaagcacataattttcctatttgtcatctttctgaatctcaagcaagtgcttcctgcctggaagacattagttcacatatttgactcacgtatactctgaattttaagtgtattttgactctgcctctacagtggttaccacatgcttatccattatttattattgagttttatatgcatttgtacttttcaactgacccatatccagccattggtcatacatgagctttcccttggctctgttctcctgggccaattctgggcatggacttttaaactcaccttcccattttgacccagccattcctcagttatcccctcagctgaaacttgatttctgtgaatgcacttagtcactgagtgtggggagggaggtgacttgaaaagcaggtgctacatctcataattaaattatgtaatcctggtacttcagaatctcctggtctctgttgttacatttccttatgaacttctgaggggattaggaagtacttcagaacttcctttcctagtaggcatatgtttcttttttttttttttttttgagatggagtcttgctctgttgcccagactggagtgcagtggtgcgatctcggctcactgcaagctctgcctcctgggttcccgccattctcctacctcagcctcctgagtagctgggactacaggcacctgccaccatgcctggctaattttttgtatttttagtagagacggggtttcaccgtgttagccaggatgctctcaatctcctgacctcgtgatatgcccaccttggcctcccaaagtgctgggattacaggggtgagccactgcacctggccaggtaggcatacctttaaataatactactgattaagagaggcctgtgcatgttttgtggctaataagtaggcagaactagaataaataagatttacacttactggtctagacaacttaccttgggaattgcaacctaggtttggggacttgaccttccaagtctgtggactgacttgcaaactaaccatacttttcggcttgctaaccaagtcttgatctggaaagtaagatctccccgaggactgtcagatctacttgggcaatacttttcagtctgcattagaatcacattttaaaattccctatgcttaggtcccatcccaggtcaatttaatcagaatttctggtgatggagccagaactatttaaataaaagtctcccaagtgattctaaatgaaacaaagttggaaaactacagtctcaaaagataaattggactaaacctctagagttgaaaactcacccaaatttattgtacaagggtcaaaaagtggctgagtgccccatctgggatggtgaggcagatgaggggttgctggttactaatattggcattccttcctttcattgtgagttgctcttataacttgcacctgctgctctctagcaacatgagcctgaggtccaatgttaaactgaggcatgtgacacctgtgctcagatcagtgggcacccagggaccattaaagacttttctttcttacactctttgcctttgtgttccttggagaagaacttcaaaagagcaagcccttcctcagggccatcatggtcatctaaggtttagtacacattttagtaatgacacattaaagataacttaaatatacattttttgagggataaatatcaacatgaggaatagaggactcttggccaggtgcggtggctcatacctgtaatcccagcgctttgggaggctgaggcaggaggattgctatgggttcaagatcagcctgggccaatagtgagattcctatctctactaaaaaaaaaaaaaaaaaagaacagaaggctcttaattacctgtccaagctcttcagacaatcaagaccagtccttgtggagattaaaaatttcagaaactaaaagtttgttatagcttggtcattgctctcatgaagcagcataacttggtcctcctagtgctctgtgaatgtgaaaatgaaaactctctttgtctgtgcttctgttgctgttgctgacgtactctccacttgtctggtttattgataattcactctccagtattacactccatcctctggagggaatgatggatcccttcatcacaaaatgttttctgtatttgcactcttctatgattccctgctcatcccttaagacaaacccttctttaagtcccggatgataacaagagtgatgattgcagcactctgtatttattaagtgtctaccatgtttcagaaacttcacattagttatcttattcaatgctcttaataccttgtattggtccattttcatagtgctataaggaactagctgagactgtataatttatgaagaaaagaggtttaattaattcatagttccacaggcttaacaggaagcatgactgggaggcctcaggaaacttacaatcatggtggaaggtgaaggggaatgacacatgtcttaccatggtggagcaggagagagagacagtgaagggggaagtgccacacacttttaaaccatcagatctcattagtatcagttagtatcagtcagttttcacactgctacacttactacctaagactgtgcaatttatgaagaaaagaggtgtaactgactcacagttccacaagcttaacaagaagcatgactgggaggcctcaagaaacttacaatcatggcggaaggtgaaggggaagcaacacatcttaccatggtggagcaggagagagagagccaagagggaatgccacaagcttttaaaccatcagatctcatgagaactcacacactatcacaagaacagcaagggggaaatctgccttcatgattcactcgcctcccaccaggcccctcctccagtttgacatgagatttggccagagacgcaaatgcaaaccatattatgtctcctttgaagtaagtcttattgcccttattatatacgtaaagtaatcaaggtttagaaaggatagttaattttcccaaggacacatagctggttgatggcggaaccaagattcttctaacagactctaaaagttgtactctttccttttcataccaatatatttttaaaaatgggtagatatgctgaaagtttatcaggttttatcattaaaacctggggtcactgaagtaaagctatctttcactaactatctgtaaattgatagtcaactatcctgggaagttaagtgacccgccacccttaatatttagcatgaatcaatttaattagttcctttagtttcttcagacaaatggaagttatcttaaaggggatggaataaaggaagaaagaagcagttgtgcaaaaggaggtggaaataggtctcagaaaggatgctgttgaaatgaaggggcccacttttttttaaatgaaattgctttttaattcagttaagagaataaaagagatgaaatatgcagttatattttcttttatacttacctacataattacctttaccagcactttttttgtgtgtgtgcatagattcaaacggtattgtgtggtgtcacttgctttctgcctgaagaacttcctttattatttcttgtaaagcaatcttctactaacaaatttttccctgcttttgtttatcttgaatgtctttatttagcctttatttaaaactagcctattttttccagagatttaaaagctcactttatatttgctttctttaaccttttattttaggtttgggggtacatgtgcaggtttgttacataggtaaactcgtataacaggggtttgttgtacacattatttcatcacccaggttaaggccagtacccaatagttatcttttctgctcctctccctccctccactctccaccctcaagtagaccctagtgtctagtgtctgttgttcccttctttgtgttcatgagttctcatcatttagctcccacttataagtaagaacatatgatatttggttttccgttcctggttcctccagcatggatggagctggaggctattatccttagcaaactaacccaggaacagaaacatacatctcattcttttttatggctgcatagtattccatggtgtttatgtcccacattttctttatccaatctgtcattgataggcattttggttgattctatgtctttgctattgtgaatagtgctgcaatcaatgcacatttgcttgcatgtgtctttatggtagaatgatttgtattcctctgggtatatgcccagtaatgggattgctattaaatgtaaatggtaattcttcttttagctctttgaaggatcgccatactgctttccacaatggttgaattaatttacactcccacgaacagtgtatgtgttcccttttctccataacctcaccaacatctattattttttgcctttttcataatagccatactggctcaagtgagatggtatctcattttggttttgatttgcatttctttaacgatcagtgatactgagcttttttttgtttgcttgttggatgcatgtgtgtcttcttttgaaaagtgtctgttcatgtgggatccaggtttcatacagcaaacagaagcaagcacaggtgcagcctcatgtttgtttacattgattcagagtttgagctggtttcaccggtttgactcacagttttctttgttgaggctaggtgagttcctgctaacgactctgtaccacacacacacaaatcactcagtatcactcaagattagttctgttttaatgatgaacttagcattcatacatgtaatcctaagagtagttatagtttgtggatcaactcacatatgaccttaagatctcatgtcttctgacaagagcaatatggcacattggcttaagtgccgcatagaagacttgctagaccaatcagtgtcttctagattctattagaaatgctattttttaaatgtccagttggaaattttcaatggcttgtttcaagattaacaaattattgtggactctgtactgccttgcttgtcgtctcatactatgtgtaacatgtattatatgtatgcataacatataatatccttcctgatattatggtgtttctgtatagcacagtgtgattcttatatccacattaatatatttttacctttacgaattttgaatctttccatgcatttgtttaaattttactgttaaaatgggccaacatgataccacacatccaaagaagtgaaaaatatgccagcgaatgaaagaatacatttaccttgtttttggttattcaccaaggaactgtccatgcttgcttttaggttgccatgtagttgaatcttctgtcttcagtttcccttaaatgttctcttttttttttcttttttcaggtgagaccaggacaggtaatcggcagaactgacaataatttcttcagtttaagatacatttcaagagacttttgcagtgcggtttaaattcagcaacaaatggccgggcgcggtggctcacgcctgtaatcccagtactttgggagatggaggcgggtggatcacgaggtcaggagatcgagaccatcctggctaaaacggtgaaaccccatctctactaaaaatacaaaaaattagccgggcgtggtggcgggtgcctgtagtcccagctactcgggaggctgaggcaggagaatggcgtgaacccgggaggcggagcttgcagtgagccgagatcgcgccacggcactccagcctgggcggcagggcgacactccatctcaaaaaaaaaaaaaaaaaaaaaattcagcagcaaatattgatttctgtgtctgctcgtagttattaggcaatagaggcagacaaacacaaatgaatgctttatgtcctttgagggctcacaatccatttgaagtggaaagagagataaattccttttttttttagacttttttttttttttttttttagatgaagtctggtactgtcacctaggctggagtgcagtggtgcaatctccgctcactgcaacctctacctcctgggttcaagcaattatcctgcctcagcctcccaagtagttgggattacaggtgcatgccactatgcctggctaactttttatatttttagtagagatgggggtttcactatgttggccaggctggtcttgaactcctgacttcgtgatctgcccacctcggcctctcaaagtgctgggattacaggcgtgagccactgcgcccggtaggagataaattcttgactgtaatacgtgacagactggggcaaggtctatactaaagaagccatggcaataccagggaagaggagttaagtcctgcctgggaaaaacagatgaggaagtatttaatatggatctgaaggaagcataaattgtcacttggtcaatatggagagggaggacttatattccaggcagagaagagagcttgagcaaaagagtacaggcaagtatagagcatgctcacggaacggcaataaatcagtgagggtgggagagggaagcagaggaaatggcttaagagaacatgtatgtgaagccaagattgcattggattttgaattccagattaaggagcctggccttattcattctaccttcgccgaagagtcctacagattctgtgtttcagagggtaattttgattgtggtctagatgaggaagaactagtcaagaattaagagagacagtctacactgaatcagtttgagctggtttcatagttttgaggagacagaatctgatgtgttagcacatcacgagggcgagggacaggaagaaaacacaaataatccagaattttcaagttcaagtgcttggaaatattcatgccatgcacaagcaaagaaatggaatttagaggggtctaggattaggagcaaagacaatgaaacaaggggttatggagccccctttttactcttttcaaattttctggcatgatatactttctaagacattgacacattctcatcttattcaacctttggtaaggcattttctcatctcacaagatagaggtgatagaaataatgtatccatttatttctaaaagattatgtaaaacaacctgaaccagtttaattaggggaaaagattttgggtcgaaataattcagaattttctgccaaagaaaatgaaaataaattcactttaaatccttagcagtttattgggcatttgtcacatgcagcagtagctgaagagagtggcagtgataatgatgcagatgtagttacttattttcattcagtccttcaacctgctgttatcctcttcagggcagacttcacttcctggttcctcagtgtatagatgagggggttcagtaatggagtgacaacagtgtaaaacacagccgctgccccatccagggggtctttggagccagccctaaggtagatgaaaatacaggggacatagtagactgtgaccacgattaggtgggagccacaggtggagaaggcccggcgcctcccatcagtggtgcgtatcttcaggatggcatttactatgttggcatacgagagcagaattaacatgaagcaactggcggccactaccccgacgtccacaaaggtcacaagctcattgacagttgtgtcagcacaggccagtctcaatactgcggggatgtcacagataaagtaatccacctgattgggcccacagtagggcaggcggaaggtcaaggtggcctggatagacccatgcatggagccggcgacccaagctccagccacaaggactgtgcataacctcccattcatgagcactgggtagcgcaggggctgacatattgccaggtacctgtcataggccatcaaggtgtagaggaagcactgggtgctgcccaggaagtgaaagaaatacagttgagccacacagccaccaaacgggatagccttgatggaaggagtaaaatccaaaataagcagaggaacggtgactgaggagagccacatgtccaggaatgagagcactcccagaagaatgtacatggggcgagcacagagcttcgggtcagcccacatggtgagcagaatgagcaggttccccagctgagtgaggatgtaaatgatgaagaagaccaggaagaggaggcttcttagatttggggggtgagacaaacccagaagaatgaaatctgtcaccacggcatccagcgatgtgtttttggtctttcccatgtctttttgtagtctgctaagatgaatggtgacgtttgacaagagaaacacagcacaatgatgttgtaagtgaatgcttttgtcggatgattgatgcctaggaattatgagataaacaagatagagtcaaattgttttttaaaagaggaggtggtgtcaccattagttatttaggtttacttaaaaggagaagtcctccagaggctggttagtttcctagatgggaggaaactcttgtccattgagagatactgaaagccaggatttgccagatgaaggaagagggacacatgagagtgatagagaagtaccgaaaattccaaccaaaaagtgagttcgccaaggaggggctaaagttgatgcagagcagtgtggaacaaacaccctataatgaccacatctactttttcttcacctactatcattgtcccctttttcctcagctaaaatctcatctccttaacatatcatgcaaaaatattcctcatctggcccttatttatatcgctattgtaccacttgtaattccttcttattgttgggaggcatgacactcttcaagcttctcacagtagtgtgctctaacttgggacttacgcacacactatcttttctgctcccttcacataggtagtgcccacttttccttcaggattcagtttgagtgtcttcaccttcaagaaggctttccggatccctgaggacaatgcttatacttttctgagcacgtacattatgttgcattgtctaatttctgtttttctctcttaataatcatcccgtctagcatgctaaaagtgataaataccgtaattattttctgaatgactgagatagatagaatggatgttgccaaatccccctgactgaatacattgtttctcttgatcttttttgtctgacccctgtgctcacatggctgggacttttaggtcaagggaccacctcattcaccatgtaatatgggtataatttcattataaaaaactccaagaaacatttatgcctgtttttgctccaggatatcatttagatttatttgttgatttatatggttcattggtttgggattgggttttttttttggtatgaggtcacagaggaatttttattgtttgttataaaatcattgattaatgcaggacttgatctttagtgtgcttgtgtgtaatatctatgtattgcagtctatcaaacagcaactctctctaaagacatttacagattttcaagtatctgaacaagatgataaaatagagggatggaatgtgtttgtttcactctttttgttaaataggttgcttgataaagacttttcgctctatatatggtttgagatgcatttatctttcatttaactacaaaatatctttgtaatgcaaatgactactttcataaagcaattaaaatgacaatagattattataaataacatgtgaatattaataagtttaatctctatcggaaattctccaaagagattttatcttaagtattctgtgaaataacttaattcatatgttaacattcaagagttattagtagtaataataataatactgaatatatctggctcttcgaagtctggaaaatgttaaacttgtcctttgcccaccaagaacgaagaaatatcagatttttattgcctgagtttcaggaggacactttgatttatttgaaaatggatgggaaaactaaatcttatttttgtggttagaatatagagaaaagaggctgggcgtggtggctcacgtctgtaatcccagcactttgggaggccgaggcaggcagatcatgaggtcaagagatggagaccaccctgaccaacatggtgaaaccctgtctctactaaaaatacaaaaaaattagctgggtgtggtgtcgggcgcctgtagtcccagctactcgggaggctgaggcaggagaatctcttgaacccgggaggcggaagttgcagtgagtggagatcgcaccactgcactccagcctggtgacagagagagactctgtctcaaaaagaaaaaaaaaaaatgaatatagagcaaagatagaaagagttgagattaaaatggtgcataaaatactaattatggccaggcgcggtggctcatgcctgtaatcccagcactttgggaggccaaggtgggtggatcacgaggtcaggagattgagaccatcctggctaacacggtgaaaccccgtctctactaaaaatacaaaaattagctgggtgtggtggtgggcgcctgtagtcccagctactcgggatgctgaggcaggagaatggcgtgaacccgggaggcggaggttgcagtgagccaagattgcgccactgcactccagcctgggtcacagagcgagactccatctcttaaaaaaatatatatacatatacatatatatatatatatatacttattatgagctaaaagtaattttcttttctttctttttttttgtgtgattgagtcttgctctgttgcccaggctggagtacagtggcctgatctcggctcactgcaacctctgcctcccagattcaagtgattctcctgcctcagcctcccaagtagctgcgactacaggtgcgcgccaccacgcccagctaatttttgtatttttggtagagagggagtttcaccatattggccaggctggtcttgaactcctgacctcatgatccacccaccttggcctcccaaagtgctgggattataggcgtgagccaccgcgcccagctgagctaaagtaattttctttgccaatacaggaatataaactagtaggcttctacttaggcaaataatatattcatgaaatgttttatgaaaatccatttttatatttaaaatcagatagaactgtaccactggggcaattatttgaaggacttccatgatgcatactttcgtatagtgaaaagtttatccctaatttatctactttgccggtctgattttcccccttttgttgtgcctaagtctggtttcatttctcccaggctccctgttgaaagaaagctctttttacccctctaggttctgggttccctgcctgggaggaggcaggaaactgagatgggttatagctggtcggtttgaggacaggatacctttccaggcagacttggtaaagaacagtggttttagcttggtgtttggtattcagaggctgcagaggaagatagcttagacttccagaaggtagatttttggagaaacaaagagtgtgtttacagaaggattggctttcttggcaagagaggtgaacagtctgggaccaccttagaggagacaaaagaaaggccgggcatggtggctcatgcctgtaatcccagcactttgggaggatgaggctggagaatcgcttgggcccagaagtttgagaccagcctaggcaacatagtgggaccctgtctgtaaaaaaaattttaaaaattagccaggtataatggtgggcacctgtagtcctaatttctcaggaggctgagacaggaggatcactggagcctggaaggtcaaggctgcagtgagccatgatggtgccactgtactccttcctgggtgacaggttgagaccttgtctaaaaaaaaaaaaaaaaaaaagacaaatgtagaggccgtatttgtgtatcctcttttccccctcccttatcttccagatttgtgtcattttattttaggtctgttcctcttttttagcttttgaaacttatgatatttaagataaggaaagttaaatacaattttagtatatctaccctagctaattagataaccaaaatattctaaaattccccaagttttagactgtattggatattctccaattagataggtcagaatttaaataatcaaaacacatgaaaataacaaaaagttaaagttcaatataaaaagcatctgaaaataagagcccagtgacatcagagaataaacagcatatttttacaaagcaattatcctggaaactctaagaagagactttgggaatggggtgaaagagtagcactgagaaggtaaggacagggagggtcaagaacaccttcaagggacctctatggcattatgggatcacaggataagctgctttctatgcccctactctgccccaaatcaagctagtttgatatgtgaacacatttcttgcagtgtatttagagaggtgccgaggagggcaagcctctatccagcaatttgaacctagatttctacagtgacctttgggatctggactactatgcaacggttatgaaatcttgaagatgaggagtgaaggctggtccagcattgcgttggacacattatgatcaaaggactcctgtttacccttgtgacaaaactcaacccaatctgcttccaaaaagaagtttcaccttctgtcatcctttattcagagttagacatcctggtagagctagggcagagtagaggaaatggatagaatttgaggtggcctagacatattttatcgaattcacaagagtacattctttcctattaccgggggttaaaaaaaacgaacttgctttagaaaaagtacttagtgccctcttcattggagaaggggaaggttatgaatccagcctttctttgtgtttgcacaatcactgaagaatattcttcaagacccctatgactttatcactgcccaactctgccctttatcactgccctaataaaaagagaatatgaaaagaaaatagtgttgtaatgcttttttttgagtcattttctcaacacaaaaagagtttccccaagtttgaaaagaaggaacttaattctagcccgtttgggaaagagttgaggaaacgcatggagaaaagagacggattaaattaacactcggacaaaataacagaaagtcttaaagttccaaaattagtctgcagccttattttgaacatagctggtgtcaggcctgctttttccatccttttagactcacttgtatagagctgcacaattgtggaggaggctggctgcccttgagtgcaacggtccagcggatggagagatggtcttcagagattcagtctagcctactataaagggctcccacatctgtttcggaaagcctttataatttttttttaaggagtttggcccagcaaataagtgttcagaatctttgagaacgcctgtctttggggttcttggacaagtgtgacttctgtatatattcagtcatattttatatcagtttccatcagctgttgcttttttggattaaaagaaaaaaagacactgccaagagatttaaagaaaaattctaacctcgagggaaaccctactactctgaagtatgtccctaatgagatctttcctcaccaaatcctcattattttgttttgagagagagagctggaaatgtttccagtaggatccctggataaggaactgtggggaataaccttgtttgcatgttatttgaatgacctctaatttcttagaggtgttatgaagtctcaactgatccccttccctccccaaatactcatcaggattccaccatcatcttcaggtttctgttcaggcatcacctaatcagagaggtttctgttgactctctcctttcccttccctattttatttttctctcggcacttgccaccatttgacatactgtatttacttgtttgtttactgcttgtctcccttcactagaatgtgggttttgcttagctttgaatccccagcactactagcatagtgcctggcatgtaataatttctcaatatgtacttctgaataaattaatagttgaaactgccacacatgttaaatgctgtgggcagaaaaaaaaagctgtggtttcaaatataaatctaatgtttaaaattacctggagtagatctgacatcaaattgatcctcgagtgacctgcatataccagggcaagtagcttcggaaatctatttattcattttttcatatttaatgttgggcagggcacagtggctcatgcctgtaatcccaacagtttgggaggctgaggcaggaggatcgcttgcagcctggagttcaagagcagcctgtacaatatagcgagacctcatctcaacaataaaatacaaaaaattagctgggtgcctgtagtcctagctacatgagaggcagaggcagaaggagcgcttgagcccagaaggttgagcctgcagtgaaccatgatcccgccactgcactccagcatgggcgactgagagagaccctctctcaaaaaaaaaaaaaaaaaaattcatgttaatctaaataacagtgggaaattgactacaaatgaagatatgaagcctggagtgtgataaaagcttcaagagtttcaagaacttcccctgtaagatgatggagctcgacaaagactggatgatttctaagtttcttttaattctaaagtaagaaaatgttaggcgtgtgtgtgtgtgtgtgtgtgtgtgtgtgtgtgtgtgtgtgaagttgcactgctacctgttgccacaagatgacagtatcatctttattgaaacaaagtacagttgctatatggagtaaatagaaataaatccagagagttcatgagggatataaattactttggtaaagatattatatgtgaggcattaattagtttgggaaaactatgtatcaaaaagagttaacttccttttgtaacacatgggaaatagtttgaaatatagttttcttcctccctccgtcttttccttcctgttttacacctagtcttcctccttccttttttattctttctttttctttcttccacattctcagtttattatgtaacaaatttcaagtcaaaggaaacagagatatataagaaaaagttaacattttcaccatttcttttaatttcactcatctgaagaaactaatttttttttttttttgagggagttttgctcttgtcacccaggctggagtgcaatggtgtgatgtcagctcactgcaatctccacctcccaggttcaagtgattctcctgcctcagactcccgaggagctgggattacaggcatgcgccaccatgcccggctaattttgtattcttaatagagatggggtttcaccgtgttggtcaggctggcctcaaacgcctgaccttaggtgatccacctgcctcagcttcccaaaatgttgggattacaggcgtaagccactgtgcccggcagtaactaatgttaatagcttttttctcatttcttcctgtatattcgtacatgtacatacacctacagacatacaaattatgtttcttttgaactttaaattaatatctgatcatctgttgggagacaaatttagatggttgaaaactctctgtttcttccttattgtcacaaacaccaccaccaccactaccaccaacacacacacacacacacacacacacacacacacacacacacaccccacctctaattgcaaccttgtttccatttcttcctgtcttgagaagagaaacacttatggggaaattgaatactttgtctttttttttttttttttttttttttttgagacggagtctcactttgtcgcccaggctggagtgcagtggcgcgatctctgctcactgcaaactccgcctcccgggttcccgccattctcctgcctcagcctctcgagtagctgggactacaggcgcccgccacagcgcccagctaatttttttgtattttttggtagagacggggtttcaccgtgttagccaggatggtctcgatctcctgacctcgtgatccgcccacctcggcctcccaaagcgctgggattaaaggcgtgagccaccgcgcccggcctactttgtcttatgttattcccatttgccgtctctgttccttatacattatgctttttcaactttaccagaatcacttggattaaaacccgtggatttctcagtaggaaatgttcatgtgaagacacttctgtagtaacagaacctacagctgctcctgtagaaggaagttgaaagtcatcccttcaagaaaggggctcctccccttgtaattctactgggttttgcatccagactgagtttccttccctcacccacatgaagtgtctaccttctgcagactccaatggctcaggaactgggaatgcagtgccaggctcgtggtatcctgcagcagatgtggggagttttccttctttatgtttccatgaagatgggaggtaagtctcaatctaatagcaaatgctgctgggagttttcaaaacgattttctttcagctaaatgattgccatttctgacactcgtaacaaaagtgtttcttaatagatattttctttatgcggtgctaattgttattggatatcaaataataacgactttgctgccatttatttctaagaatctctccttaatggcaattcttttgtgaccacatggagacatcgtttttaatgataatgggtttccaggagcgctgccctagtaacagtcatgtatcttgtcttaggcactacaggacaaaacattgaccagcccactgagatgacagctacggaaggtgccattgtccagatcaactgcacgtaccagacatctgggttcaacgggctgttctggtaccagcaacatgctggcgaagcacctacatttctgtcttacaatgttctggatggtttggaggagaaaggtcgtttttcttcattccttagtcggtctaaagggtacagttacctccttttgaaggagctccagatgaaagactctgcctcttacctctgtgctgtgagagacacggtgactatgaggcctctttagctgcaccaaaattcaaaaggcaaccacagcagcgagaagctgtatttcctgagtgtatgcctgctgtgagttaagactggggactttggaaccagactgcctggatttgagtttgctactctctagttgggtggtcttaagtcagtcactatttttttttcttttggtttatttccttatccagaaagtgagaataatgagtatctacttcacaagcctgttgtgagttatgactctctgtatcatctatatctctatctatagctatatctagtgttactcagagaagtagtggcacacagtaaactttatttaagtttagttatttcaattctagtcttgaattttcactaagtattacgtggtaggacctctgagactggaactcagtatttctctacccttggtttgtggaaggtgaaatcctgaccactatttgtatcttgtggatctaaagctccacctaatgatggagtttgtcgttcaggtggattgttgctttggaaggatcactgtggtgatactcattttctttggggggactccgaactttggaaatccaaatgcaaatgcttcagagtgagatgttaagtagcctgattaattacgaaaggctatcttcattatgtgcatcctctataaataaatgtaatcttaacatattttggaggtttataactcagactagaagtgaagtttaggggcttcagacttggggagcatgaacataatcaggggagtctatagaagatgggaaaaagaatgaacataaacaatttggtggcaaatctgggtgaggcaggagagccagtaggagattcctatgacaagatgcagtcagtaggcattaagcacaataaaaatttacagtaaatgttaagattttcatttcctgctttataattcccttatgttctcttcaaatcttttaatgaagtctgttaaatgctacaacttgctgtcagctaggtttagagagtacacgattgctgtgtggctacctccacatgagataaagccgatcagagtgcagaagctcagattgcaggttattgggacatcaaaagtgagggctgctccaagttaacatagttatatggccagtcatatgttacatatatatatattttttgagtcaaagattaagcaaaattctctttgggtgagataggagtgctttttcattctaatttataaaatgaacatttgaggtggaatttgaacagacatagtcacactggaaagtaatcttgacaacatgaatccaggccactgaaatgttcatgttccttttgtctaataattcatttttttgagctctcatttaaataaatgcaggctagaaatgaggctttgtttttttccagtttacaagacaaccaaagaagccatagaaatgatatttaagggctttggacttggtgagtatgaattgttcatatagttatcaattagggaaaacaatactatgcaaatgatatggtgaatgctatgatcaatggaatattttaaagttgtattagtttctattgctgcataacaaattaccacaatacccatatattagcttgtagttctgtaggtcataagtccaagcaagttcagctgagttccatgcttagggcataaccatagtaaagtcgaggcattggctgggtgagtactcaagtgctcacacagagttcagagtcctcttccaagttaattctttaaatttttttctattttatatatatatatatatatatatatttttagacggtgtctcgctctgtcacacaggctggagtgcagtggcgtgatctcggttcactgcaagctctgcctccctggttcatgccattcttctgcctcagcctcccgagtagctgggaatacaggtacccgccaccatgcttggctaattttttgtatttttagtagagacagggtttcaccatgttagccaggagggtcttgatttccctgaccttgggatctgcttgccttggcctcccaaagtgctgagattacaggtgtgagccaccgtgcccggcctattttttatatattttttaaaatttagagacaaggtgtttctctgttgcctggggtagagggcagtggcatgatcataggtcactgtgggatcaaattcctgggctcaggaaattctctcacctcagcctcccaagtagctagggctataggcacatactaccatacctggctaattaatatatatatttttgtagagacagggtcctgctctgttgcctaggctggttttgaactcttgagctcaagcagtcctctggactcagcctcctgagttgtgattacaggtgctttttttttttcttttttttttttcggagatggagtcttgctctgttgctgaggctggagtgcagtggtaggatttcagctcactgtaacctctgcctcctgggttcaagcgattcttctgcctcggcctcccaagtagctgggattacaggtacctgccaccatgcctggctaattttcctatttttagtagagacaaagtttcatcttgttggccaggctggtctcgaactcctgacctcaagtgatccgctcgcctcggcctcccaaagtgctgggattactagtgtgagccaccatgcccggccagttcttattattgtcagaattctagtccatgtagatgtgggactaaagttcccatattcttaatgtttgtgggctgggggcatttctgagctccttaaggcaacctgcactctttctcatgtgagtcccaccatcttcaaacgagcaatagcatgtgaagttcatctcatgcttggaatctttctggcttaatcttccaaagttcatgtgtttttaaggtctcatgtcaaccggtacatagatatctcccttttgaaaagtcaactgtgggcctggtgtggtggctcacacctgtaatcccagcactttgagaggccgaggcgggtggatcacctgaggtcaggagtttgagaccagcctgaccaacgtgaaaccctgtctttctactaaaaatacaaaaattagctgggcgtggtggtgggcgcctgtaatcccaactacttgggaggctgaggcaggagaattgcttgaacccggaaggcggaggtttcagtgagccgagatcttgccattgcagtccagtctgggcaacagaacgagactccatctcaaaaaaaaaaaaaaaaaaaaaagtcaactgtttgttcagcgcggtgcctcacgcctgtaatcctaactctttgggatgccgagttgggcggatcacttgaggtcaggatcaaaaccagcctggccaacatggtgaaaccccatctctactaaaaatacaaaaaagttagctgagcatggtggtgggcacctgtaatcccagctactagggaggctgaggcaggagaattgcttgaacccaggaggctgaggttgcagtgagccgagattgcaccactgcactccagtctgggggacagaggtgattctgtctcaaaaaataaaataaaataaaataaaacaaaacaaaacaaacaaaaagtcaactgtgccatagaacccaacacaatcaccagagtaatattgcataacattcaagattctgaggattagggcagggaatcttgggtctattcactgaaattttacctaccacatagcaaataaaggatgtccattaagactgcataaaaatggtgaactgcttatgatataacaatgaatcaagaaaaccagtgtgcataattgaatatgcggaataatcacagctgtgtaaaaacttttgggcatagaaaaacagggaaaggaattacaatcttccctctttactgcatttcccttactcaaagtcttagtatgggtagattttcttctctctctctccctctagtctcttggctaggattggagggtgcacttccaagatggcttgctcacatagctgttgttggcaaaagtccccagattcttatcacatggctgtagtgtgttgacagagagagagacagagagagagagagagagagagagagagagagagccatcttttattgtccagtctcagaagtgttataccatcacttctgctgttttttttcccccagcttctaacatttttctccttttacatataacaaagtagaagaaataatataggattcaaactgcaaaagtagttaatcagtagaatgtatacacacacaaaatatccccataagaagacaggcttatttacaatgaagaaacacatgtacatttaagatagttctcatataaaacatttaaaaaataaaacatatcccacaatgggcaccactgtttacagcaatattaaaggggagaaaacaacactcatttaatggtgagcattaaatgtaaaggtacagcatcagtggaataaattcacaaaactatattacagcttgttaatccatttaagaattgttccaaatatatcatatatttggccctcagaggttcattcctacagatttcaactactgtaaatttctagctactgagaggtagaaaatggttattatcatgattataatgattattagaaacacacacacacacacacacacacacacacacacaaactcaccaaggagttacaaaatctatggagaccagaggccaactatcatcacctcatgtctgctctcaccaacagccttgcatttttcagagaactatctaaaaaaatagtcagacaccagtgtgatcactatctcctatgccaaacctattgggaatgaaacaagcagtattaccataaatgagaacattgaggcttacctttcaaggcttattctggtctcagaaattaattagatacgattattttctattgaaatgaattttagctaacataaaagactagtcctttactagctggtcttagggtaaaggtcgtacacatgagtcttaacctactctctgtcatagctaaagtcagctgaaaatccaaaattaaaagtatgccaaaaatcctaagtacaatcttttggaagtctgctgtgaaaaagcctttaaggatgtactaacttgaagtctaagtgcaaggtcataagagctctaacgctgttagatcttcctcgtttgggagaaaggatcaatgttccctacaaaacgctaagttttgcataaaggtgaaacctacatatactagggtatagaattaatttaattttgttccatcaggatcctttttccatggtaaaaaagcagaatgaggaatgaaggaatgaatcttttttttttttttttttttgagacggagtctcgctctgtcgcccaggctggagtgcagtggcgcgatcagggctcactgtaagctccgcctcccgggttcacgccattctcctgcctcagcctcccgagtagctgggactacaggtgcccgccaccacgtccagctaattttttttgtatttttagtagagacggggtttcacagtgttagccaggatggtctcgatctcctaacctgtgatccgcccgcctcggcctcccaaagtgctgggattacagccatgaaccactgcgcccggccgaggaataaatcttaattggcctcttcatcagaagaggtaaacttggtctctgtattcatgaagctagacagttttttaagcaggcagtggaagcagacagtagaacaagattcctgtagccacagaccactacctggtatcaaactaaagcaaggatcaacttaaacaattatccaaagtcattttaactgtactaaagggtaaagttcaccactgtattattttaaaggaagttgtttaatgtaagaattccattaaccctgggtgagaaaaatcaaaacaagtcatactctctaatgagttatccatgtaagaccaccaataaaaatgcttttaactgtatttgactcgaagacacttacttggtaagtgtgaatttctttcttttttttttcttttatcccattggatttagactattgaataattaagggtagagtgagggagaacaaagagctacttctttaacattttagtatctggatagtatagcagaaactgttcctagggacaatgtatatgccattaatcacattgaataaagtggatgaattattcatttttcttttctttttgttcgagaagcttgtttatctccctttggcctttccagtgtggtttgaaatgattccgtgttggtttagttgaggaagcaacagtaagaaagtcactgtcaggtagctgagaagcaggttgtggacttgctgtcccatccaaacaactgcagcgagataaatgatcatggccatgaaacacatttcaggcttttcttccttcagtgcgaagatttgtttccaccagtccatagctctgcattgagtttttagtagattgctgcaaatttcatggaatttttgctgttgattgctggtgcatttattggagccaaaaatgttaggtgctagaatgggaacaaggtagtcagccaagcaccaaaacacaacaaaagaggaaacagcagacagaacagatggatctagatagtagataattgaagcaccaaagaaaccaagtccatgatggcaggtgaaaaccaagctctttcccataataagactttatccaccatcaacatcacttttccccattcttgcagctattgttctaaacttgcagtctctgcagccagcaaattggtgccgtggttacctccctctgccatcatccctgaagtgctgtctcagcaagcacaaaccaccctccaactcagccttcctcctgagatccacagggcgattctggccacttctgctgtattctgttggtcacacagacccacccttatacagtgtagaaggcgattgcacagtggtgtgaataccagagatgatggagatcattgaggtcatcttgttgactggcttccatttaccaactcctgtcagccattggttgaaggatattaattttattaattaccagggatattaattttctagtattcagggtttactatgtacatgggcaaagaaagcgccagttgccagaaagatcccctcaggcacagaggtgctgacagttgaaagttgggccgtccatggaaaatgtaaacgggttatgcagaggagggtattgatagtgtcagtcaacccttccactgctttgataccctcttacccaacattatatttgctttgtactgtcattgattcctcaaggtggtggctgattacagtttcttaaaaaaaaaaaaaaaaaagacctaaaacagaggatttagccagataagtagagttgttgctgcagttggtcccaagaccatcactgttatctattgtctccctcttctatcactcattctaggctccctcattcagcattcctgctggtctcagtttcttgctctttggtgactcagaccttcatccctgaagggcccaagcccctggttactgtacccttttcagaccttggttgatgcaattacctcttcactgctatcaccaagcatggaaacaccaagacatgttccaatacatctctgagttccattggtacttctctctatccccgttacatagtagcaactctatatcctcatgatagtagtcaattacctctgccactatagttttgccaaatttggggagttttcaggcattatttctttgaatactttttcagtcccacttctttcctcttaaactccaatgatatgaacttagatctcttgttattatcccataggtctctgaaactctgctcatttttctttcagtctattttctccctgtttttcaaactgagtaaattctattgatctgtttaaagtttacagattcagttctctggcatctcccctttatattaaatctatccagagagctttttaatttcagttattgtatttttcagttctctggactcagctgctgcctcaaattcctgggcttaagaaatcctccttcctcagcctcccgagtagttggaactacaggcactcaccaccacgcccagctgattttcaattttttgtagagatgggatctcactatattgcccaggctggtctcaaactcctgggctcaagtgatcctcctacctcagcctcccaaagtgatgggattataggcatgagccaccatgcctggactcacttattgaagcatttttgtgagagctgttttaaagtccttttccaataatttgagcatctgattcgtcttcgtattgaatcagttgattgtcttttctcatttatgttctgatttcctaattcttggaatgaaaagtaatttttgattgtagcctggacattatgggttttttattaggaaacctggatcttatttaatcttctttttagcaggtagttctcctgttgagatgtagtgtaaagtttggtgaatatatatgttcagtttcctgctgggtgccactggcaccaccccaccaaaaggggaccattaagtcacattgccttattgcctctgaatggagatgatcagctttctgctgggccagctgggagaggggaaaggagagggccaactagacttacctcctgcctggttggtatggcaggagtggaggcttagctcaccagtggtccttgttgacaagggagtgggaacaggaactctgattagccctactttccattgctttgttcaattacatggccactggatgggtgtggaggttcagctcctcactgggcattgctgacattggggtgggggaagctgagtgtttactgtctcacctcatagcacctcattctacctcattgttgctaggtagagatggaggctcagctcattgttggacctcactgacagtatcttgctgggagactggagcaccacctgcttctgccatctggggaatggaagatcagctccctgtttggcctgctgacactaccaagggggaaaccagagtgcacagtggcttctattgggaaggaaggtggggtggaagatcaacttccttgctcactgactgagacctgggggtgtggtttatttgttggtgtttagctggagcaggaagggtattgccagaaagatttcctgctgttaggccaccgcctttttccttgtcctttggctagaaggaatgggctttccttggagcttttgttatctatgcatattggtgtctccaggttggaggtttctgtaacatcctgtccagaaatttttttgataaatattagggtggtatattatttttccttttttaaaaattctaatgtagttattgatatgattggtttaaatctaccattttgtgatttgttttctattttccccatttcttctgtgttcattttctttcctttttggtctagattgagtttttttgtatgtttgtttttgggttttattttagtatttaattttatttcatcttcactataatcttattagttatattactttatgttagctgttgctctagaatttagattatacatctttaatatagtataacttcaagtgatattatatcatttcctgtatgatataagaaactttcaaacttctgtttttctcctcccaggctttttgttattactttaatatattttacttctacatgttataaatttcacaatatatttttgctttatatagtcaaaatatttaaaaagcgatttaaaaactgattataaaacactttgatatttttgccttacttataaagattaccttacccagacaacctgtaaagtgtggagaatatagatttatagatattgctttgaacatctgcccaagcagtagaagaggcaaattaggaagtgtttagcaagatgcttctggaagctaagttagttcgaggctgtatatcaggcatcctgggtacccactgactggtaccaatttacttagtgttcatgggtgaggtttcacttgtccatggactttgaatccctggtgtgtatgcagtggttattacagtggctctacaaactaatgtcatgctaattgccaaaggtttggaactcttccatatttgaaggcttctggattttttgtccacttattaaatggctaaatgaatgagactaataacaggaagggcattggaatggaaaacttttaataatacctccgagtattcattgatggcaagttcagttatgtcatgtgatgatcacttcaaaatcctgtgtcagataggtaaaaattccaaagctttcaagcctaaaatttaccctgtgcagaattttgagtttcatgattttatatcctaggcttctataatagggtatcagaggcgaatggaatcattagaggagatacagagtagatggtaagtgtgtgatatatattgagaacatttattttaaacaaataagatagatagtttttatgtataaacaaatgttactgattatacattgaagaatattgctttggactttagaagacagcctaagcttaatagagctcctgggttgattgatttgattttatgatgctgagttttgctatcctcttcctgcctcacctttataatgtgatcatgattattgttacttatttaaggtgggtgctgaggtgaggagaaaggagataataggctctttaagaaaagcttatctcctgagagtgataaatgtacagtggtcttcctaaacttcaccacagtcccatcttgatgatcattgcaaagaaggtaattatattagtcagagttctccagagaagcagaaccaaaggttttacacacatgcacgcacacacacacacgcatgcacacacacacacgcatgcacacacacacatgcacacacacgctgcatgcacacacatgcatgcacacacacacagatgcacacacacacacacgcatgcacacacacatacataaattagtcctttggtatacatgggaggattggtttccaggatgcccctaccaatagccaaatctgtagtcatccctgcagaactggtatatactaagttgaccctccatatacatgggttttgcatcctgtgagtgctgcattttcaatctgcgtttggttgaaaaaaaatctgcgtataagtggactcagttcaaatccgtgttgttcaagagtcaactgtgtgtatatacattatatatataaaatgagagagagagagagagagagagagtcagagatagcttgatttattatgagactgtggattgtgggtttggaaagtttaaagtattcacagcagggctgcaggctggaaattccagcaggagttactgttgcagtcttgaatctagaggcagtctggaaatagaattctttcttcttcttaggacctcagtcatttttcttaaggccttctactgattacatgaagcctcgccacattatggagggcaatttgctttacttgaagtctactgatataaatattaatcacatctaaaaaataccttcaaagcaacagctagatcatagtttgaccaaataactgggtaccatggcctagccacgatgacacagaaaattaactattatagtaattaaagggataaaattattacctgcattccataatgaaaataaagagacttgctcaagtatacgcagagtaatatatgagttggctaaaggagcaaaaagaagcagaatccaaatttatatatgtatattgacaggaaatatgctttcatttgacaatatttattagttctgatgcacaagaatagactaagacaaattggctttgatttgccacagaccccttaaaaatttttgtattttcttaccgggccccatggctccagcctataatcctggctactcaggaggctgaagtgggaggatagcttgacaccaagaactcgagaccaacctgggaaacatagtgagaacttgtctctaaaaaaattcaaaacaccaacaaactagccaggtatggtggcatgtgcttgtagtcccagccactgggaacgctgaagtgggaggattgcttgagtccaggagtttgaagctacagggaactatgattgcaccattgtattacagcctgggtgacagagcaagactctgtccctaaaaaaagttttaaaaattttcttaatacaaaactttaagcttaatgttagtatcaagttatatcccctaaaagtgtgctttctattaatatgaactaaaaatgaatactttttttctataaaaaaatttgttgaatgcgtcttaaaatgcagttccaatggtgcccatggtagttactgattaaagtggtaatggcaagtagacgtagttctgtcttagttggcctgacaaaagtcaaagtattgtaaaggaaaaatgtaaaatttgcagaaaagaaaaaggattaaaaaaaaccaaggaccaatattaaaaaggcgaaaccgctgggcgtgatggctcatgcctgtaaactcagcactttgggaggctgaggcaagagaatcacttgagcccaggaatttgagaccaaccagagcaacatagcgaagcccctgtctctacaaaaaaaccaaccaaccaaccaaaaacaaaaaacaagaaacacaacaaaacaaacaaccaaaaaaaaaaaagcaatgaacaaaaaaacaaaaaattagctggacatggttggtgtgtgcctgtagtcccagctacttgggaggttgagatgggagaatcgcataagcccaggaagttgaggctgcaatgagctgtgatcatgccactgcactccagcctaggtgacagagtgagactctctctctctctcactcacacacatgtacacatacacacaacttaaaaaggtgaaactgttcaaacagaaagccagttactaatatccaaatcagagtgtattttatttcatgttttttaggattttgctttttctgtttcatttctagaaacaattatgagaaaagtgaatgaaataacattatagtaactttataacaattagctaaagcatccctgcacaactggagaaaactggtaagttttaccactacctgcgctgcttgtcatgctttttgtgggtctgcacatgtatgctcatatgtacattacgtacttggtattgagcaagacttgtctgatatgtcacttaagtgtgtgtttagaagtttaatagaagaccttttaatttatgagagttgttttaacctcttttctgtctaaggaatcagaatacttttttaacatgttgctgcctatgaaggcacctgcacacacagacaaaacacacatacgcacaccctccaggattcctcaagatgtctggggttacgacttgtcacctttagagtttgccacagcactgatttctttttcctagttatcgaacactccgtaggttatggagtcttgaggttgtaagggatcaagaccatcacttctgtttgctttttggatttgaatacctagaacagtgcctggaatatagcagacactcacacataattataggatgaatgttgaatgttgaaaagatgaagtcttttttactggcagatggccattcagtctttgtttctaagagcaaggaagtccttacgcagcaaacctgtgctctgaaagtcagtgtacagattagttttgggctgttctggagaagatttggaggactacagttgaggcctggtagctctgctcctctgggatttcttaccctgggtcactctttgggacataactcaccatgactacatcattgtaatgtatggagttgtgatgttaaatgcttccttccttccttccttccttccttccttccttccttccttccttcctttctttcttccttccttcctttctttctttctttctctttctttcttctttctttccttccttccttccttccttccttccttccttccttccttccttccttccttccttccttccttctttctttgtttttctttctttctttctttctttctttttctgtctgtctctctctctctctctctctcccccttcccttcccttcccttcctttctttttttaacggagttttgctcttgttgcccaggctggagctcggtggcacgatcccagctcactgcaacccctacctcccaggttcaagccattctcctgcctcagcctcccaagtagctgggattataggcatgcgccaccacgcccagctaattttgtatttttagtagaaacggggtttctccatgttggccaggctggtctcaaactcccgacctcaggtgatccaccccctcggcctcctaaagtgctgggattacaggcataagccactgcacccagcctctaaatgctttctatgtatgcagaagcaaggacatcattttgttcttaccctacacaaccttcagctctaaaactttcacagcagttttttttttctcagagatttctttcccagttttagttggtaactgagtagatggtctcctcatatacagagaagaatcaaatctttaaaaaataaactaaatttaatatgctgaaagggatttaggagttaatccaactcagctctctgcagccaactattgagtaatagaaaggcctagggacaggagaattgggacagaattccaatcttgccatgcaaaagctgggaaagccacaaaacacctctgaagcttacctgcatcccattttattagggagatgaacctgtcaaaggttagagcgtgttcctatgaacttctgccttgtctcttcttgagggtttaagccctggcattcaatcagtataggcagttctcttatatcagatccatctaagcaagaccttggaagctctggattttacaaatccatttgaggctaacacgataatggtctactgtgatggaaaatcatgttcctcttggcaaaaggagccttctctaagtaacacttctctaagtgggtccttgccaaggattgagcctttagtgctgaaagagagatcaggtagaaacagagacaagaggcagagaaagatagggttggaggtatcattgatgaaaagtaaagatgagtaggctgaaactggggtcagggagtagaggtcactgatctctggaaagtcacgatactcttcagaggtatgatttcaaaaaggggaaagttgttgctgtctacattgtggagctgctgtgggaactctagagctcttggaagaaaggtaaaaaaggtagacaaagagcaggaagagatagatttcattgaccttcagtttttttttttaaatgaagaattctaatatacgcagtatacaatacacaatactgatgtctagtggggattctggtgcttttagctcaattgcccctttgtaaataagatttctgctgattgccttaaaatgggtaattattttgatgtacagatcaacttacccccaaatttttggatttttcataattcttccttgcagtgctactttgaaaatatctttaaaaattttatttattttatttttagacagggtcttgatctgttgcccaggctggcttgcagtggcatgatcatagctcactgcagcctcaaactcctgagcttaaatgtttctcctgcttcagtctctggagtagctaggactatagacatgtgccaccacactcagctaattttaaaatttttgtagagatgcagtgtcactatgttgcccaggctggtcatgaactcctggcctcaagcaatcctcttgcctcagccttccaaagtgctgggaggctgaggcaggaagattgctttgtcctacttttaaaacattaaaaaaattaattcaataagtattcagtgagttcttcctttatgccagttactttgctctgtggatagaaaaatgaatgagatatttcccttccttcagggagtgcatagttggatcttattgctacttaaatcccattttatgtttttttcttttagttctttggttaagaacgtaggctctgaaaaattcaaattccattttagccagttgctgagtgaccatgagtgaattatttaatcttgcaaatattttgggaagcaatttgataataatatattttgaggtataatctttaagctagtaaactcatttctagtaatctattcctaacggaataatatattagagaagttataatcgttcaaaaatatgtattgagcaactgctatgttctatatactttcctagataatttggatgattcatagagcgaaacaaagatccctgtccttttagaatttatattctagcagcaggagaaagaaaataataaacaatagactaaataagtgaattatacagtatattagaaggtgatcagtgctttcaaaaaataaaaaaggtagatcaggataaaggggatcaggagtgctggaattctcggtgagttttagttttatattatgttcatcagcataaaccttgttgagaaggtgatgtttgagcaaagacatcaagggggtgagggagttaattatgccagtggtccccaacctttttggcaccagggaccagtttcatggaagacaaatttttccatggactgggggtgggggcgattggtttcaggataaaactgtttcacctacatcatcaggcattagattctcacaaggagtgcacaatctagatccctcacatgtgcagttcacaatagggtttgcgattgaggatttaatgccaaggctgatctgacaggaggcagagctcaggtggtgatgctgaagcactcacctcctgctgtgcagcctggtacccatctgtggcccaggtgctggggaccccagaattatgggatatctgggggaagagattccaaacagaggaagcagccagtgcagtggccccagagtgggactgtgttttgagtatttgaggaataccaaggaggacaacgtgattggagctgaaaggaagagtggtaggagacgaggtcagagaggaaatgggaagttgtgtcattgagggctttacaggccaaagtaaagacttcacttacaatgtgtgaacagggagccatcgaaagtcttcgaattagtgaaatgatttaatctgatctatttttttttttttttttaaagatggcatctcgctgtgctgcctaggcagaccttgaacttctggacttaagcgatagatcctccacctcagcctcttgagtatttgggactacaggcacgtgtcactgcacccagcttgacctatgttttaataggatttctcactgtaatgttgagaaagattgtaccattatttttaatagtgagaaattagaaacatcataaatggccacaaaggatggactgggtgcacacatttgaatacatatatgtgatgaaatgtcacttggttatacacttatgatataatactgagtgaaaaatagaatataaaattatatgtttataatacaattggaacaaattaaagataacagcagtaggataagaacaagctatgggtattcttctcacttgcttttccctgtgcatgcttttaatactttgttttaaaacaaagtaacccatgcttattatacaaacttgaacaattatgaattataatgtaaaaattaataaaatcctatcatttccttcaattccatacttctagaattaactaatgttaaaattgatgtgtgttcgtcaacaactatcttgtgtccttctaggaataaatatatacaaacataattcatgaatatgtatatatgtttgaatatgtataaatattaatatgttgaagcatatgcatgtacatatatgcgtaaatatatatgcatacacacacaaatctttttcgatttctttcttcctttgttcattcattcctttgtccctcccttcctcactccctgccttctttccttcaaggttcgtaatatactcataataggttcttttgcttaacaatatgttattgacattccatgaattagtagtttgtaatcttggctgcacactggactctccaaggagtattaatagtgctgatgggtccaattgtcagaaattctgaattgatggtttggcatgaggcctgggtatcaaaatttataaaacttctttaagtggttctaatgtgcagccacattgagaaccactgccttaggttatacatatagatccaactcattattattattattcttaatagctcataatattccatactgtggctgtactaaaatgtgtttatctagtcctctattgagaaacattcagtttgtttccagtatgttattctactaaaaagtctttaaacatgtatctttagttctttagttaccagtttctttatttctacaaaatacagtcctataagtaaagttgctgggttcagaggtatgagtgtttaaaattttaattggcactgctagattattttccaaaaagatctcaataatacctacttctagtagcagtgttaagagtactcctttccttatatctttgttaatccgatgaatgacaaaaagtatttgattttctttttaatctattactaattaagcatatttttattcatacttatttgtcatttgaagttctttttctgtgacttaagtatatctttgctcatttttaattgagtcgtttgtcttttcttatcaagttttaagagatcttggataacaggagtattcttttttggttatctatgttacaatattttcttcacgtctaccttttttttgataatttatatggcactatatattttgttattattattatttttttcagacggagtcttgctctgttgcccaggcttgagtgcactggtgcaatcttggctcactgcagcctctgcctccctggttcagttcaagcaattctcctgcctcagcctcctgagtagctgggattacaggcatgcaccactacacctggctaatttttgtatttttagtaaagatgaggtttcaccatattggtctggctggtcttgaactcctgacctcgtgatccacctgcctcggcctcccaaagtgctaggattacaggcatgagccaccacgcctggctggcattatatattttaaattattgagaaagtttaacacgctttatctcatttttattcattatgtttaatattttttcacgttggtaggcctttgtcactattgttcctaatgtaagccccatgacattgttcctgatgtaagccctgtgaactactgttcctaatgtaaacccctaatgtaagcctcacgttattttaaataatactatagttaatatttccttgcatttagcttttttcatagtttgaatgcttacaagtgaaataattggatcaagaatataaattatttttgtggcttgtgataattatttcccaacggttatagtttttggccagccatcagtataaaaagttagggtaatataactttagtatttatacaataatatcatattacgtaatttaaagaagtaagtttcttaagtattttcttagctccattgtgaaggaaggcttgagttctttttcaggctgcctaagaagttaggttcagttcaagtaaaaattgtttttgcatacccattgtgtacaaggcacctactaagtgctgcaaaggataagtcctgtgtggttactactcttaaaaaaattttagtctgggcgcggtggctcacgcctgtaatcccagcactttgggaggccgaggtgggtggatcacgaggtcaggagattgagaccaccctggctaacatggtgaaaccccgtctctactaaaaatacaaaaaaattagctgggtgtggtggtgggagcctgtagtcccagctacttgggaggctgagataggagaatggtgtgaacctggaaggcggagcttgcagtgagccgagaccatgccactgcactccagcctgggcaacagagcaagactccgtctcgaaaaaaattttttttttttgatttagtggagagcaaaaatgaacatcttattttactttattttacaggtcaaggaccataaaagaagcctgagagggaatagataggctttgactgggtcaggaaagttttcttaaaggtagtgttctttgaaatagtcaaagacaaagtgaaggatgaatagtatttttttcttcacctttaagttcatggataagtgtgcaggatgtgcagttttgttacataggtaaacgtgtggcatggtggtttacagcacagatcgtcaggtattaagcccagacctccacaggtgtagagtgggtccacgtgttctcattattcagctcccacttataaatgggaacatgtgatgtttggttttctgttcctgcattagtttgctgaggataatggcttccaagtctatccatgtccctgcaaaggacatgatcttgttcctttttatggctgcataatatttcatggtgttatgtaccacattttctttattcattctatcattgatgggcatttaggctgattccatgactttgctattgtaaacagtgctgcaatgagcatacatgtacatgtatctttataattgaataatttattttcctttggttatatacccagtaatgggattgctgggtcaaatggtatttctggttctagatctttgaggaatcaccacactgtcttccacaatggttgaactaatttacagtcccatcaacagtgtaaaaatgtcccttttcctccacaacctcaccaacatctgttcttctgttgttttttggctttttcataatagccaatggtatctcattgtggttttgatttgcgtttctctaatgatcagtgatgttgagctttttttcctgtttgttggccacataaatgtcttcttttgagaagtgtctgttcatgttctttgcccatttttaatggagttgtttgtatattaatagtaaacaatgaggtgaggagagtacacttgaatagagtgtatgttttctgagcagagggaaaagaaaaagtaaagacaaagattttggaaggtaagtaggtggaggtaggatgcctggaggacagtgacttgcttggtcagagagaagaattaatagggagaataaaaggacactcacattgaaaaaatgaaaatgtgcagcagactgttgcaggctttgaatgtatatctaatttgatagaagagtcaaattatttagttgggagttgtattggaatattagcttaatgttatcagtgctttagtttgaagtgaaaagagccaaataactaatgtgtaaggtttcgggcatttatttattcttgtaaaggctcactgatctcatctgcaaggcagaaacaattgattcatgtgccatagggtggttgtgtttaaatagaagtgcctggcatggctcctggtaagtagtgggtatactgtaacaactactgttaaattgatttcataagctatatgctctgatgataaataagcaattcagataagaatacaaagtcatttcaattagttctattcctataataataaaactaaattagctttcattttttcccccctaagctcattgaatggacagtctaaaccaaacaagagtgactgaatttgtcttcttgggactcactgataaccgggtgctggaaatgctgtttttcatggcattctcagccatttatatgctaacgctttcggggaacattctcatcatcattgccacagtctttactccaagtctccatacccccatgtatttcttcctgagcaatctgtcctttattgacatctgccactcatctgtcactgtgcctaagatgttggagggtttgcttttagaaagaaagaccatttcctttgacaactgcatcacacagctcttcttcctacatctctttgcctgtgccgagatctttctgctgatcattatggcgtatgatcgttacgtggctatctgcactccactccactaccccaatgtgatgaacatgagagtctgtatacagcttgtctttgctctctggttggggggtactgttcactcactagggcagaccttcttgactattcgtctaccttactgtggccccaacattattgacagctacttctgtgatgtgcctcttgttatcaagctggcctgcacagatacatacctcacaggaatactgattgtgaccaatagtggaaccatctccctctcctgtttcttggccgtggtcacctcctatatggtcatcctggtttctcttcgaaaacactcagctgaagggcgccggaaagccctgtctacctgctcggcccacttcatggtggttgccctcttctttgggccatgtatcttcatctatactcggccagacaccagcttctccattgacaaggtggtgtctgtcttctacacagtggtcacccctttgctgaatcccttcatttacaccttgaggaatgaggaggtaaaaagtgccatgaagcagctcaggcagagacaagtttttttcacgaaatcatatacataatgggcactgggattgcagacataattgcagccacatccttaatgaaagagcaaaagtaaagagtcaaaatcaacttatataacttggtaaattaggtaaaatggcatagagcaggtcagatttctgctcattaaagataagaacttattctgttcattaaagataagaacttattaactattatttaaataaagcaaaagatcatagtggaagttataaggaaaaataacgtgggaaagtttaaagacagcttttgatttcatcagtaaaagaatacaatttggggaactcagttcagtctcagtttcaggagcaggtagagtgagaattgactctcttgatttatactgttctgtgggctattgcctctgggaagctatacatcactcctgtgatttatacattatagtagtttcaatcttgttttccaatatattttcaagtgtataaataagcctttacttatttatattgaattaaacttttgttgcttttgaatgtaattctctcatgtctagatctattttgtactttttttttgagacaggaattttttgtactattcctgcaacttcctgtaagtctgaaattattgtcaaaataaaaagttaaaacaaaacaaaactatacacccacaagaatagtaaaaattaaaaaggtagaaaataccaagtggttttttttttttttttcctaattactctgtcgcccaggctggagtgcagtggcgccatcttagctcactgcaacttccacctccaggtttaagtgattctcctgcctcagcctcctgaatagctgggactataggtgcatgccatcatgcctggctaatttttatatgtttagtagagatgaggttttaccacgttggccaggctggtctcaaaactcctgagttcaagccacctgcccctctcagctaatcattaactactatcactcattgggctgaagtatatcagtttattgtggaatgggcaagtccatatgaagagggatccatgacaaatttcttaggtaatgatgatgatattctgtgactgaaataagtaggattagctgtaaatgaagatcctatagatggtcagagagctaccatacaatatcaactttaatggagctgatggaatgaaatgaaatatggttaataataaaaatattaagtataaatatgtttctttgcttattctgaaaaaaatttataattgattggggtctttgtcactattttccacatggtctgtcaacttatagaaataatacttgagtattctggagaactggagagcagacaacatagccatccacacattacagacatacacaatacagagtgagtgacccactaactctaactaaagagtaatacatgattaccttttagtaatcaaaaggacaaagaatcagaagcagtctattcattaaactgagagatgctcatgaaaatatctaaatatcattacttcaagttgacaaacaagggtagaaaatggtcagtcccctataattctcatataaaacttgagtcatagtaagagttttagatatctatgatgaaatgaagtccagatatcactactatgtacatgttaaaaacttagaaaaatgatctaattatgcctctagtttctggacttttatgtgcataagtattcatactcattaatatcttttatgcagaaataaattcccactgtcttatttgtttatttgtattatggcactattcattattttaccgtatagaacatggttgtaacctgaagaattcaattgttgaatacaaagttgctgagcagatttctatattaataaataatgattcctctctcctgttaaagtaagtaaaccacagagccaagcatcaagatcttttatttttgttctttaagactctctatttatttagtgagtaattaaatacatttttatcttgtctctgagtctgaaaagcttttttctgtaaaacggagacaaaatgttttatttttacgtccccagagagttgaaaaattagtgtgactaaaaacgggtagtgtcagaaattttgcttgctgctatgaaaaaaataagcaaacatcacaacgttgttccgttatagttttaccagctacaatcttaatggctacgttgaagcattgtgttgttgacagacaatatgacaattttgcacgtgttcctctgtatggctgattcctgcacaagcagttccatttgggctcattggaaagatatttagatatttctccttattgtctgccattgcctataataaaagggcatttattttacataaattttataattcttgtgtcacttgaatatccttcctaacacatttcctagcaaataaaaattttcctcctaaaaatcatgatgtagaccttgtggctcacaggtttattgatcatacactcactgagtgcctaggaaatcccagctgcatttaagcatgccttttttagcgatgatgtgagaacaaactgatgatttccaatgtgtcatgctcttttgtaaacatgaatatgagatgccgttatctgggatatcctcttcatatcccagttgattcaccacattccattctgctacactatgtgccgccacagtgagatttaagatgttggtttatagacaatggtttatccaacttggtgttttctaccaagtttctaccaagttgttttctaagtatttatgactaagtacttaacagtcatccattgctctaagaacaatattggatgctgttgcttagttgagtgaattctctacataataactaaaataattttattaaaacataaattatttcatgccacacctgtgcttaaatcattctggtggcttcttattgtactggaaaagattctaaacttcttgagagaatatggaaagattctttttagctctctgatatcactctcttgccactctctgccttatagtctaagctgtaatcacactgatcatttacttccttgaacaagccaaggtctttcccagcatagatctttgcaccggccatttcccctgtctagaatgtccatcacctctcttatggctggctccttttaatcttaaatgtaacttcctcagagaggccatccttgaccactaaagcaagtctcttccatactctctaacagcaccctgctgttttatagcatttatcacaatctgtagttaaaatttatttgttcatatttttgttttctattttcactagaccctaaactccatgaaggaaggactacatgtatgtcttatttatggctataaacctagtatctggtacataataagtgctcagtaaatatttgtcaaatgaatgaatagtaagatatccccatttcattgctctgatggcagattttgcctggatacttgagagtgtcagtaacttcacctgttcaaagtcttctttctctgtcaccaaagtcatgtggaaactcactttatctgcttcactagtgtttgctaagctgtttacataagcatctgagtgaatgatgcaggcaagggctgcccagaaatctgaaggtttgtttagaccttggttatcactccaacagaaaagcagaaagaggcagcatatgttgtgaaaagagcttgagtttctgttgatccacttggattcacatgctgccttcattgttttctagctgagtgactttgggcatgttatttactctcctcgagctttagtttcttcatgtacaaacaagcatcataatatctacctttcaaagttgtgagaattaagtaaatgcacagtgcctagaataatttccagcacagagaagatattaataaccataacgattgctatgactgtcagatattggaccaaggatagttttataagtcacatagtctgataaatatggtatgtaacttattctttgcaaggcgcttctttaatttggagcaccacgtatcctaaggacgtagacattttcatttttcttcttttctctcttttctccccactaacttgtttaaggcactcttcatttcttcattcctaagggtatagataatggggttcagcaggggggtgactgcagtgaaaaacacagatactaccttgtcctctgggaggctggtggatgggcgggaatagatgaagatgcagtgtcccaggaacagtgtaactacagtgagatgggctgcacaggtggacagggccttccgcttgcccttggagatctgctgcctcagactcaccaggatgactgcgtaggacaccaccaggaccacaaaacagaccacggagatcaatccactgttggagacaatgaggatctcaatgacgtgggtgtcaatgcaggccagcttgatcacctgaggtacatcacagaagaagttgtcaatctcatcaggaccacagtagggcagcttgatggtaagggaggtgagggctatggagtggatggtccctcctgtccagagggccacagccagcagcacacataccttccagttcatcactatcatgtactgcaggggtttacagatggccacataccgatcataggccatgacggtgaggaggaagatctctgtgcaggcaaagaggtgcaggaagaacatctgggtcacacaggcatcaaaagagatgagcttttcctctgaccacacgtctctcagcatcttggggacagtgacagtggagtggcagacatcaataaaggacaggttgctgaggaagaaatacatgggagtatggagccggtggtcatagataatagttatgacaatgagaacattcccaatcagtgtcaggacataaaaaatgaggaacatggaaaacatagctatccgtgccttatgatttacagataaacctctaagccgaaaatatgtcactaaagaagtttgattgagtaggatggcctcttccattctctttgttagacaacctgtaaagaattagaaaaaaagtctaatataacacagtatctgcatcaatcatttggtcatttaatttcttgtgtgtttatgccttttctctccatctagaatttatggtaaaatatcttgcatttcttttaaaaatccccattaacatcttacatgatgatacacccatagtaggtacttaacatacacttttggaataataaaatagagaatcttcattcattaagagatataaaacaatcttgaagagggagagagagagggaaagaccaaacaagttatttctccattaatgtagtaggatatcaatgtttagatttaggttatggatttttacaggagaagaagttaagattctctttaactcaaatacataatttgttcaaggctacacaaatatggtccctgaacatagcttttttttttaatagtcctgcagactgcacttttcatcaacccaaaccacttgctcagctgttggctttgccatggggctctgagactgtaatttccatgacataactttcagagggcagaagctttgtaccaagctactggacaattggcaacgtggctgtgatgttcttgaacaattgtttagagaaggcaggataaaaccctggaagccttggaaaatgtggaagttgacctctcctccacccctcagctgagggcagacttattcttaaactgggagtcaagatccaagcctaataacattactgtcttgattagatcactctagctcttttcaaagtcccgttctgttgtcttactggcccacaagtgaaataaaaatagttattttcttttaaattagcctatgactcaagcaccactattttttaaaataacgagcatatgcattatagtcacaggattttagcccttaaagggacttgagagttgacataatctatttttttttcattttacaaatagagaaaatgaggcacagagagtcaaatcaactggtccaaggttacacggaactggagtcacagctgggtctagagctcaggtctcccgactcttggttcaggcttcgtccgctctaccaccactctcatctgaatttttgtggtagttggtagaatcagggagtgaagcagaatatgtcttagtggcctctctcttcctctccttggtgtcctgagtcagattgtggggcagggttagggggactatgaggaatctctcttttctagctttcctccttcatgctgctgccctgacacacacagccttccaggggtggcccacccaaggaagctgtctctcttggttgcttgggccccatgatccttgctacttccttcctatcacaagtgactactggagatttatatcatccctcaagatcaggctccctggcagactaatgagtcaaccccacactgcttgtgaaatgtggcaaagaagatatttttggggccagagaagtccttcagttaacacttaaaaattaaactcactgtgtccagtgtttggattaatatttacagcagcatctaaatgtagctattgattgattttactgtttagaaatttttcttcgagtattcgtttgaagcttttgctccaagaagtgattttaagtgttactgatttacacttgttttcatggtcgcaaaattcaaagccgaagagctgaccaagaatggggctaggattttattcagtatgggaaatttcacctgcacagactgaagagggtgtgcagaccaagaactaggtctgaaatgaaggcttctgttctcccctcatagaatatggatatacattttaaactaaactttttccataattatcatttttttctatttctgtggagccacaggaaaaaaatgctttgcaaaatggagatgtgttcaactgcagtagaaagaatatggtgcacaagaagaaaacctagtgttttttgcatacatttcaaggaaatggggaaagatgattaagaacagatataaaatccaactaaaatatctataaaagtcacctgggttgtttctgatgctcttagtacctccaaaagtaacagaagtgtcagtcctgcactttcaatatcaagacttttatcttccagtagaaataacaacttatttgaagttggactagtcagataaccccatttaccttgctttctccaataagaaaggtgagagcccttgaagttccctccttaggtcttgttcacagttttggtgatgtcacagtagatgtatttggcgatattttctggtaaaaggtactatttcaggctgtctgtaaaaatcacacctttgtagctatattattatcatatttttcaatatgtcaaaatatgtaattctgcaccaagattttctaggattggtttccagttaacagaaaatgtagtacagaaataatatatatgttttcacttttccagattgtagtggtgagtagaggagattaaaagccacagtcaagcccgggcaacatggcgaaaccccgtctctacaaaaaatacaaaaaattagctgggcatgttggcttatacctgtggttccagctgctcaggaggctgaggcaggaggatttcttgaacccaggaggtcaaggctgcagtgagccgtgattttaccactgcactccatcctgagcaacacaacgaccctgtccaaaaaaaaaaaaaaaaaaaaagagtcagccacttttgcaggcccttcaggtttattaggacacttctaacacaaaacttgatctaattattcagaaaaccagtgcggcagaagcatcctatttcctttgcagcacactgtttaggtgcaagttttgtattgccagtttcaggtggattattccaccttcaagtactgaaggggaatctgtagagaaagaagcgctggcagctgtagtgttggtgttgttctacctacattatataggctttatgtccttgggaacttttaagcaatgacatcagcttgccctactcactagttaagaaaagttaattctgtggggaatgaagttacagactttgcaataatcaccaagagaattaaatgagaaaagcagtacttaaatacctaaatctttaggatgtatttatatatggttagattaactactatttagtgattgcctactatgtgctaagtattaggtaataggctttcatgttttcttatttaactcatataaaaatacagagatgagagaagggtaatgaagttaagatttttttttttttttgagatggagtctcactctgtcacccaggctagagtacagtggcgcgatctctgctcactgcaggcgccgttccccaggtttacgccattctcctgcctcagcctcctgtgtagctgggactacgggtgcctgctaccttgcccggctaattttttttgtatttttagtagagacggggtttcaccgtgttagccaggatggtcttgatctcctgacctcgtgatccgcctgcctcggccttccaaagtgctggaattacaggcatgagctactgcgcccagccgaggttaagattttagtcagctttctgacagagagattaagtgctttgactctagagcagattgggtgcaaattccaatgtcctacacgtgctaattggagcaagttatttagcttctctggtccttagatttcccatccgtaagcttgaatagtaatagtaaaactttttagaactcttgaaatatttgtaaagcatgtagctcttagcatattaatataattatgttaaatgcaattcaaacaaacaaaaaaacagccgaccatcactaccagtcaacatttttggcttcattttttcattattttggataacagtgaaaatttagaacctcttgttccaattttctttttgctttctctctttagatagatgagcttggtggtttaaattggtgaaacaagactccaaaggagaggtatgaagattatactttcagtttgaatttcaagactgaatagttttgtgggatggttaggatatcttaaataaagggtatggagcataaaataaatcttatagccaactctccatgtgacagtgagtagaagagaagatggtaataagagtgaacatatcagaagttacagaaaatgctttctcctaaggccttgtggcttgggcttcttttccctagttttcttgtttgattcattatcactgatcaaagtccagacttggctgtaatgaagaaggtgtagcttccagaactttacagatattgccacttggtcactgtgggacttctattgtcattgtaatagccttggaaatcaggggacacattaagaacagggatatgctggccatactaattatctgttaaaacaaatgaaatatggcctgagaaggactctgtacttgagtccttgtggatgacctgtaacctagcttaataggcagacaagattgaaaacctaacttaggagtatgcacctgtaacagtagctgagttttggccaatcccagcagccatacttcaaccactcatagtctgctaagtgttcaaactgtgttcaaataaggcaaatgtcaacctggtgcaccaatccagctgtttctatacctcacttctgatttctgtacttcatttccccttttcttttgtctgtaaatcttcttccaccatgtggctgtgctggagtctctctgaatcttgctttgattctgggggctgcctgatttgcgaatgatactttgctcaattaaacttctttaaatttaatttggctgaagcttttcttttaacaaatggtgtcagaagtgggatctgaagtagaccttctaacaacctccaaaattgctgagtcaacaagcaagttacctgatgaacgtatttgtgtcctttgatgtctcagaatggctggggattgtggtaagttctctctcagatttcggagctccacagatttatgttttgagctctccaggtttctttgagcaaatttctgatccaaactgggtttgaaagtcatgacagaaactggacgggttgaggatcaaatttgatctggtaattaactagcttggatccagttagaagcctcttacctctgactgggtcagaaagaaactggtagtaagaggtaatattgcaggggttataaaattttgcttttaaaaattcacaaggatttttgtgttctactcctttgtttcatttttcttgcacacttaggtaggaaagatcattggctaagttaatcaatggaacctagagccacgccaatattttaggtaaaaatgggattctcagtttctgaaaaactgagttccttctagcttatacattatacatacattatacatacatatacattccttccaacttatacattaggcctgggaagcagcaaagtcttagagaaatggtgaaatcttactaaagataatttacagtggaatgttctgaataaacaacaacatagaagtgtatttaaaaataagggctcctccacgtggctcaggcctgtaatcccagcactttgggaggcccaggcgggcggatcacgaggtcaggagatcaagaccagggtgaaaccccgtctctactaaaaatacaaaaaattagccgggcgcagtggcgggcgcatgtagtcccagctactcgggaggctgaggcaggagaatcgcatgaacccgggaggcggagcttgccctcagccgagatcgcaccactgcactccagcccaggcgacagagtaagactctgtctcaaaaaaaaacaaaaaaaaaacaaaaaaagggctcctcaaaattaaatctgctaactgtttagtttagttactatcctgatccaaaggaaacagactgcagcaccaattggctgactttgggtaagtagtggggtacattttacctgagtaaaggatgggattgcattggaggccctcccctcagtaaagtccctcttggttaaaaatggattaaagatgacagggctcaaccaggggcaagtttgagccttgccagttcaatactgcatgctaagcagagtggctaatgtctatgttttgtcacatgtattttgctctgtccagaatgccaaatgttaatttcattaccctatgcaaccccttgggtggcatcctgcaacagtgagaaaattttgcctgtggttccatgattttttgtgtatgtggttggctccctggcactatagtatgtttcagggaaggggaacccaggaacctaacacgctggcaaaagtgtaagaatttcttaccagtcaggtttctggcctctctttccctgtgcttctctttccttgtgcaaactgggaaagttctggcctctctttccctgtgtaaactggttaaatgaatggtaaaaaatcactgtttatcttctgcaaagttttgattaatggaaaaaagtatttatgaggttagtcttaagctgtagcgaatctggtatgtttatgcatcttctgtatcattctttcataaagaggggtaccataggattgaacatgggctttaaaccccataagcccactgctcaagatggcccagcaagctggtcagtaacaaactttgctgcaggatcctgaaacaaacaaaaaaactggataaggtctccatattgttttatgtctttgggagcttgaccttgtgaccatatggtggtactttctcttgctctctgccttccagggaaaaggaattttagggttcatgtcatagttacctctaaaaattatcttgagtagttaaaagcctttgcaagctcaaaattaactactctagactccttctgggatgggcagtggagacttcccagtgctgtagctcagtagctaagattttgttctttcacagtggtggcttggattcaatcctggcttaggaaatgcatactttctggttgatatctgtgtgacctttatcatttgttaattctcttcctctccatgaacaacttctgacttcccttcttgaattttcctttctttgagctacctttgaagattctagattttgtaaaaactgcatgttttcctagccctgtttcttgaagggctctgccctaaggccagaattaagaaactggcaaataaaacatctaataactactggatcttcttctgtctgtgtatttatgtatgtgttgtgtgtatgatgtttatataaaagatctctaattaattggcataaaaataagctcttaaatcaaatattttgaaagaaagataaaaatcctaatgtcttttagctcatgtaactttagtaatctttgggaaataaaaacagctttaaagattattggtaaaataaagacatttggtctaaattaggcaggtcagatattaggtttattaaatgctttaaggtcatgaactgttttgacttttgaaaattgttcaatttacctaccttgaagacactagattctagataagccctggggacatgtggaattagcaatgccccttagccatgcaaagaaggttataaagaaaagatatttttatataagaaagaatactgtatgttaaattcttatcctaaagtaaaataatggttatttaaaaagagagatgtttaggacaagtcagaaagtccaagcacactgtagatgaaagtctgtgtaagtcatgaaaggattcgtgaaaggaaatctgtgcaccaaaagcaaaagttgctgagttaccattataagatgtgattgagattactgaaaaaaatagttttacgtgcagggtatgtgaggatagtaaaatgtgtttttggcaaaagattataagaaggcatgggaatgtaaatttttgcctagtttagagggttaaaggattgttttaaattatgttagaataagctaaaagcttgaacaaggtgtagaagggttgtaaaaattaatcttgtaaaagaaattctgtgtgtgaacatattgactaaatttaaaaggggattatttgttttttctgtaaattgaacatcaaaataaaagcacaaacaggggtttcttaaagcactcatctgctctttaacaaaaatttgtaaagggttataaaaggtttatcggaatctcaccttatggtcaaactgatgaagactggttagatttgtctatagacaaatagacaatagatagattataatctatccaaattatatataatttgttttattaagaattgggtttgacattaataatatactaatgcaagggtaaaatttggctttctctcttgaacaagattttcatgtaatattaaaggataatgaaagatttttctttgccttttgagtaaactactgaaaaaacggaaagacaacagaccaattggaaagctaagtctgtcctttatcaatgagtaaaggtttttgtcttttgaaaacttcgagtcatcattttggctaaatgaatgacttatggtaatctggaatactagttcataatattaagtgttttaaacctttaacatatttaataggcttctcaaaatcaaatttcagcttcaaaattgtcttttctgacctctaattttgagatgatacagagggctcttgaagcatctaaaagagagataaacaggattatttgacatgtttagttacatgggatcgtcaaaataaaaacaatgtttaatcttcttcaggttatattttcatgaataataataatatattccaaaattttatgcatttctaaaattctgatatgtctgagtatatgctatcaatcataattatggttattgttattatagatcacagaaataaccacatttccttgtctgttctgtctttacagctatttaaagtcacttccacaggtaattgcataatgctgatgcaatttctaaaaatttcacaagcacataaaatcctaaaatatgatgtcttttaggagattcatgaaaggatggaaaggaccctgaaaagtgctcttgaatataggtttctaataactttaaaatcacatcgtgggtaaaattccccaatttccccagaattggaccgggtaagaattcctgaaactttaataaaaagactgattggtttataaaactgcttaccccagtagaacaaaaattaattaaataccgagaaaatactttgccaggttttcatgctaactcagccaatattaaaattgttgagacatacaatttgaatgaactccatgctctaactgaaattacctatgacaacccgtcagttatcagtgttatgcacctaagtcagagaaacaactggtattcaagaggacataagtctagtgttaagcatggactcatggagaaccaggaaggctgccttgtccttcctgagtccttaaagcttttgttattaaaggttctgcatttcatgactcatcatggaaaagataaaattatccacattacatgcatactggtgtggtgacttatacattgctaaattagtttgtaaccagtatttggtttgttaaatccatattcttgggaagacaaccaaagcttcaggtacacttggctacccgatgggccatttaaacatttataaagggatttcattcaattgccattttcaacgcatgttttctgtttgtataaaagctttcccatgcaagagggctgatgttataacagtagattattacgctacagtgtattttcacctggtaaagaaaggtttttatgattccctgaggacaatcagcccctacacaatctagaacccaaagattggatcttctgagaacatcagagaaagactgtccttgacatccacactatagcaaaactttggaactttgaactttgggttcgtaatctcacaactgagaagggtccctccacactcttggaactgtacatccattggaacccttaaggtaaagctaaccagggaaatttctccccagaagaagatgccatccttgatataaacagcttttcccaagatcacagatcaagacttctactattatgagactcttatctttgaatactttttccttgtttatgcctctgtgaacaatagaaatggaaagggggtctgttgtgtgcacttatatggtatacttttattcataaatgattttgcagccagccttacacatgaataaccttatacctttacagataaaaaaatgaaagcccattgtagttgagaaactttaaaggtagaaatattgccatgtaatcagtcagaaacagaacatggattcactcctcttaacccacatcgtgggctaaagagaatgttgctaggaggtcttcactcttcccaaaggcatcatttgttaggtcatttttctgtggtttgaagtaaaagaggcaatgattagaaatgtatccctcatgataggcactatagcagattctactgcaaagactatgcttacacaacagactttaaagtctcttgtgacagttatgctaaacagtagaattggctaaacagagaagaatctgtgcagtgctagcacttgtggcctaggaagaaatacattgggtattatagagattcagttgtaggggattaacaaaaagatcacttagttaagcaagtggactctttatctagctcattctttgatctatttgattttaggtggtttggtttatggggaacctgggtaaggagcatactccaaactcttggtattatcctcccaatagttaccacagtagtctctctggtgcactatattctcttgaaggttttaaatgtttgcatgcagccatctctagaatgtcaaatggtctctcttcaactggaatgacaaaagctgaagtaaacatgtgaccatgaggacaccgtaaactatgaaggacatgctgataccagaaacccaaaatgatggtaactgagagtggcactaaggccttaagtttggttacgctctcacctaagtgagaacctggccaaaaagggggaattttttagaacaaaattatgggaggccattgtattggactaagatcatgcactagaccccaacagaccaaaccaaaccaaaacggagttgcttatgctaaatttgacgtaatgaaactaagactttaaggaaacacataaattctagaacagaccaggttttgtttttctcctgaaaacagaatatttcagcatagggaggtacccactcagtccttattctctccttggaaaactcattcttctactgtttcccagcgggtttgaagaccaaataagtacatttatgatggtgatcatgacattaatgactaaagttttggtcaatctctcaaaattgagaaaatgaccaaaagtggggaattgttaaagcaagctaaatatagcctgagaaagactacatacttctatatttgagttttgtggatgaactgtaacctagcttaattgaaaaccttgcttaggagtatgtgcctgtaacaatagctgagtcttggccaatcccagtggccatacttcaaccactcaaagactgcaaagtgttcaaactctgttcaaataaggcaaatgccaacctgtaaccaatctaactgtttctatacctcactcctgacttatgtacttcattttctttttttttttcatctataaatcttcttccaccacaaggctgcactggagtctgtctgaatctgctgtgattctgggggctgcccaatttgtgaatcactcatttctcaattaaactcctttggctgaaatttttcttttaacacctctgtacttttggaatagaagtactttatcataggcatgatatatcaagggcaatacagaaaatgatattcagttgatcgtaaggcaattactctcaccacttttttagtaaaatgcaagattgagaattaatctttgactgtcttatatcacagttccctgctttcccccaagcccttggtggcctttctccttggcccatgacttttttctgactatacacagatggcctctgaggtgtcccactaaggcttttcctccctgaaagtatgtccctcttattccaaaatgtattccacagaataaatgaaaacagtggtttacacttgcatagcactttagagtttacaaagctccttctcactcattattttatttgctttttataacactcctgtgaggtagggagcactatggaaaaattggattggtgttaagtgattttcacagagtttacatgccaggttagctcccgaaccagggcttaaactcagtcttctggtgccaagtccagtgtttactccattacttcacttggatgctgcatattataaaggagaaatagcttcaagatatgaatgattggttaacctcaccttctatggaagatgcacacttaaaagaattgcttgttaaatcatatagaaatttttcattggtgtaggagagagagcagttttttaattattaactgacattttccttcttcccattctactctttccattccaaaagatcagtgatatggtcttcactgctgaaaggtcactgactcactactaaaagtaatcaatcagcagccaataacctaggatgtgtacaatatcatacttactgtagtatgagataaaaaggctcataagagtaatgatcctttcctatgaggaatttataacacagtgaattaagatgacatttattttaggagttgaaggaaaccccttgaaaaaaactttggggtgatatctgtaaacgcaatatgaattaaatgtgttgtgaccttccgtctgagcccttccatcccccacagaagaaggtaagaaatcaacagagcttgcatgcccctggtgggaccatcattctgtttttcacaataaactgctgaaaccagaccttaagaggaagctacaattagatctcatcacctacccacctgctttcaaaagagaccaatcaggttaattccctcaagctatgtatgcctgtttattccagtgttcacaacatctttgaaccttcagatcacccttatggactcttatgtccataaagcttggtactttctgtagtctaacttttatccttttcagaccctgcacacactcttcattatgtactctggctagcattttgcaagcagaatcccttatgacctccactgttttttttttttttttgcacattacctttatattactgcagtcctgttaagcagtgcagggtttttctgctatgctgggtctcaagttttggtaagtgccatttttgttttttcaaaaccatgctgattcagataatttctctttcttcctttgtagaaatttctatgcttcgaagaaaattttaacagactgttccaactgcaaccctttcttgttttatcttcaatgatcctctcagccactcaccctccctcctcaaatattttgccaattataatcatctgcacagatgaccattcaatactttggcctcagttatttagcctcttctacagtaatttcaccctccaaccctaactcagccattcccatgaacatgctcctgaattttcagtatcaataacagcaacccatccatgctgtttcaagtattctactttctgatcaccaacttttaacctttcctgttcattccttctagtactcccaattatacattttttcaaacctgccagaaacaccaatccattgatcctatcatcctctcactatcctttattcctctcagattgttactccttccttatccaacttaaactccaaggtgtaagtttataataatacctttgcatacaccttctactcatttgttcatctgccccatccactggaggtttttccaggaattatgttcaatgcaatgcccatttttggggtatgcctgagctgatgaaggaaaacacacaacaagatagaaggtcttacaattgtgaccacaacctcaaataggcagttctgcattttctgtagtcaatttacatttttactctccgtggtaattgttttatacagagtttactcaaatctttagcaaatccttctaacttttagattcagctaaagaaccgcttactattttaataaaaaaagtaatcagaagagaagttttaccccatcccactgctaactacatccaccagtctgcatctgaaactgcaaactctgcctattcttataatgggcattctgctctatctaaggccaacccctccatttgtacccgggatcccagcctttcttgcctctcaaggactttgctcgagcaactgtgtctctagcatcatcacatttcggtcactgttgaagcattcccatcagcacacaaatatgctgtaataatttcaatattaaaaaaaattccttgacatcacatttttcttcaacgggccacctattttctctgcttttctttatagctgcattccttgacagaattacctatactaatagtttccacttcatctgctaccatttgtttattgaacctactctgatctgactttgtgtctcaatgactccgctagaatagttctcacctagatcaccagtgacatccatacttccaaattcaatgggcagttcttggtccttgtctcatttgacctttcagcatcatttaacatggtcaactttttttttgtttaaatttttattttttaaattaaattaaaaaaattttttttttttttaggctgggtgtggtggctcatgcctgtaatcccagcactttgggaggcagaggcaggtggatcacctgaggtcaggagttcgagaacagcctggccaacatggcaaaaccctgtatctactaaaaatacaaaaattagccaggcatagtggtgcatgcctgtagtcctagctacttgggaggctgaggcaggagaatcgcttgaacccgggaggcagaggttgcagtgagccgagctagtgccattgcactccagctggggtgacagagtgagactctgtctcaaaaaaaaagagaacagattttttttagagtcagggtcttgctctattgcctaagctggagtggtgtgctgcctttgcctctctagaaggtaggactatagttgtgcatgaccacgcccagctgattaattttttttttgtagagataagggtcgcactagggactactggagatagccaccatgcctggctctttctcttttttgaaagaggacacttcactctcctattccccctgccccaatttcctggttgctcccttaaactctcctttatagtaccctctttctcttcatgacctctaaatgaaatgcctcaaggatcagtcctcagatttttcttttctctgtttatgctttctaagtgaacccatccaagctaattattttaatgccatctttgtgctgatcgccggaatttttatctatagccctaacttctctgagccatagttttgtatattcttttgtggcctacttaacgtctctacttggatttctaaagagtatccaaagtttaaaagcaatctaaaacaaaactcttctttgcatgctatctgaaagtgataactccattgtcctccccatttttgtaacagcattaccattcatccaactactaaacaagacattctgaattcatctttatcttctctctggtatcccacagtcagccattcatcagcaaatacaaatagctctgcacttaaagtatattctgaacctcaccacttctcagccataatcaaaggcaccattatcgcactttgactactgcaacagcttcttatctatttctctatttcaactcttgccttcctcttagatcctgctctccaatcagcaatctgattcattcttcagaatgaatcatgtgtctgtttgtactcaaaagtaatcacttccctctatcctttcttgttcattaaactctaaccacactgaattccttgtgtttcttgagcacactaaacatcctctcctcgcatgacctttgaactaactattccctttgtctagaatagtttttcaccttatagtacctggttctctgcttcattttcttcaggtctttggtgcaatgtcaccacttgagagaggacttctttgagagaggttgccaaaaagaacactccaaatctaattctgctgtcaatgacctccaaccaatcacaattagaagcaaacctgtagtcaaactaagttgggtttgttgactccttgtaatgagggagaccatggaagttccagtaagtaagaggattttagaaagaacatatagggtttgggtttttgttaggtgataatgggaaaggttcaaggaagcaggcttttctttcaaatgactattgttaggaagtaagagtaattctatagttggatatcttgataattctcctctagaaggcagtaagaatgcagaaaatgaaaattttaatgggttaaaaaagcaacgatcactcatataaccgggatagggaactatttggttatttttatggtttggacatggtcttctttttgtctgtgttaagacatgaatatggaatagtcttatttttgaaaatggaatagtcttgctccattatggtactgagtagtcttgtcagatattggtgttcagagaagctgtttagtaggagatcatcaagtcctaactatgagtgctggactagctcctagccacaccaaggcctatgtgatagtgccaggccattttctagttatcaggggtagcttttctccttcatagtcctctcttttggctgaaagcagactaggacaggccacaggacattaatctataatatccatacagtgttttcatcattgtcaaaactatgtcggttaggaggttgtctagagaatgttgtctgtagtgggactaggattggtctctctgttctttttgctgcaaaacaaattgttgaatccctttgacatgacaataaatttgaggtagcatttaagaatatggaaagtgtacattagctatattaactgcagtgcaggcaattaccagtaacacaatggttattagttcttctttttttttttttattatgctttaagttctgggatacatgtgcagaacgtgcaggtttgttacataggtgtacacgtgccatggtgatttgctgcacccatcaacccgtcatctacattaggtatttcccctaatgctatcccttccctaaaccgccaacccctgagaggccccagtgtgtgatgttccccccgctgtgtccatgtgttttcattgttcacctcccacttatgagtgagaacatgcagtgtttggtttctgttcctgtgttagtttgctgagaatgatggtttccagcttcatccatgtccctgcaaagcacattaactcgtccttttttatggctgcatagtattccatggtgtatatgtaccacattttccttatccagtttatcactgatgggcatttgggttggttccaagtctttgctattgaccagtgctgcaataaacatatgtgtgcatgtgtctttatagtagaatgatttataatcctttgggtatatacccagtaatgggattgctgggtcaaatggtatttctggtgctagatccttgatgaattgccacactgtcttccacaatggttgaactaatttacgctcccaccaacagtgtaaaagcatttctgtttctccacatcctctccagcatctgttgtttcctgactttttaatggttgtcattctaactggcgtgagatggtatctcattttagttttgatttgcattaccctaatgaccagtgatgatgaggtttttttcatatgtttcttggctacataaatgtcttcttttgagaagtgtctgttcatattctttgcctgctttttgatgggattgtttttttttcttgtaaatttgttgaagttctttgtagatttattagccctttgtcagacggatagattgcaaaaattttctcccattctgtaggttgcctgttcactctgatgatagtttctttagtggcgcagaagctctttagtttaattaaatcctatttgtcaattttgccttttgttgccattgcttttggtgttttagtcatgaagtctttgtccatgcctatgtcttgaatggtattgcccaggttttcttctagggtttttatgtttttaggtcttacgtttaagtctttaatccatcttgagttaatttttgtataagatgtaaggaaggggtccagttttacttttccgtatatagctagccagttttcccaacatcatttattaaacagggagtcctttctccattgcttgttttttgtcagatttgttaaagatcagatggttgtagatgtgtggtgttatttctgaggcctctgttctgttccattggtctatatatctgttttggtgccagtaccatgctgttttggttactgtagccttgtagtataatttgaaatcaggtagcatgatgcctccagctttgttctttttgcttaggattgtcttggctatagaggttctttttttggttccatatgaaatttaaagtagttttttctaattctgtgaagaaagtcagtgatagcttgatgaggatagcattgaatctataaattactttgggcagtatggccattttcactatattgattcttcctatccatgaacatgaaatgtttttccatttgtttgtgtcctctcttatttccttgagcagtggtttgtagttctccttgaagaggtccttcacgtcccttgtaagttgtgttcttaggtatttcattctctttgtagcagttgtgaataggagttcactcatgatttggctattattagtgtataggaatgcttgtgatttttgcaccttgattttgtatcctgagactttgctgaagttgcttctcagcttaaggagattttgggctgagacgatggggttttctaaatataaaatcatgtcatctgcaaacagagacaatttgacttcctctcttcctatttgaataccctttatttctttctcttgcctgatttccctggccagaacttccaatactatgttgaacaggagtggtgagagagggcatccctgtcttgtgccggttttcaaagggaatgtttccagtttttgcctattcagtatgatattggctgtgggtttgtcataaagagctcttattattttgaggtacgttccatcaatacctagcgagatcaacgcagaaggcgagtgatttctgcatttccagctgaggtacccagctcatctccttgggactggttagacagtgggggcagcccacagagggcaagctgaagcagggtggggtgtgtcacccgggaagcgtaaggggtcggggaactccctcccctagccaagggaagccgtgagggaccgtgcagttaggaacggtgcccagatactaggctttttccaaaaccagcaggatgaagatagggaagattatcttgatgcatcttttagttaggtaataaaggaggttagattagtggcagatcaaaatgaaagaaagagggctgagaaatcagaaaattaatcttgttttgtggtcttgggtgaaagctatccacttctgtagtcatcagcttgtagagaatttttaagaatccttaactcggggtcttccaagtgcatggatttccaggctttgtaagaaatagatgtatctttttagttagaaagcctaactcccattactgggtatatacacacccaaagaaaaataaatcattttaccaaaggacacctgcacttgcgtgtttatcgcagcatattcaaaatagcaaagacatggaatcaacctaggtgtccaacaattgtgtgctggatagagaaaatgtggtacatagatacaatggaatactacatagccataaaatagcataaaattatatcctttgcagcaacgaaggatgaagatggaggccattattttaagcgaattaacacagaaacaaaaaaccaaatactgcatgttctcacttataagtgggagttaaaccttgagtactcacagaagatgagaacaacaaatactggggaatccaaaagtcaggagggaggaaagggggaaagggctgaaaaaaaaacttcctgttggatactatgttcactatctgaatgatgacatcaatagaagcccaaaccccagcatcgtggaatatgcccttgtaataaagctgcacatgcacccctgaatctaaaataaaagtaaaaaataaaaaagcgtgactccaacgaccaacaccttgaagttttactgttgtgtcagttgttaataatccctgccaaggttcttttcactggggctgaagggctgtttctctctgacgtattttctagaagactagatctccctatttcagatcagacagtgggtgttttaaaaatgtagtttgaacctgtttgtgttaaagctggcagcatcatatgtgtctcatgtgatatttggtcacattaacctgtagtatggcataatctaggtttagaagtaaaattttcaaatgaactgggtagcttattattagctcatacggagatcacctgtgggtcccagagaaggtagatctcattgtcatgaaggctaatagaagtctgagtacttttgagaactatgccaattttagttttagaatttcattagttctttttacttttcttgatgtttgtagacggtaaagatagtgaagtcttaagtaaaagatacaggtttacagagttatttggtaatagtataagtgaattatatgcccctattactagaaagataagttaaaatttcccatattggagaaaaagaaattaaacattctggtcacaactgggccatagctctttgtcaaggacaagcatcaactcatcacaagagtaaataataaccagaacatatttatagtccattgctggggcatttatataaaatccattcagaggtgatcaaagtggccttgagcctttggttcctatcaatatcctacttttgcaatcctcccagaataatctcatcagaaagtagggcatgcatagaaaatgtctttggcaatattcctaaaattgttccaccatgttggttaaatattattgtcaatgcatctttattattttggataatattgtgaagcatttttgttaaatgcacttttattatggctatatccttaggtaatatcaaattgtctaaaagtttattaattctcctttcattttatagggattcctaaagagatgaggaaatttgcttgttttcaaagcattttaaaataatagactaactcaaaattatatctactatcaatataaatgtttgtttctttactgtttttcctctggcaggtccaggcaagggcaatgaatttaactctccaagctgatttagtttctgggagaagcttaattttcaagagtaaattcaagctcttgaattaaagctcttgagatagcataaccttctttgcaattttcagtttttaaaaaataataaactattatgtaatattgaatcaagaatatttaagggagtctctaggtctgtgcaaggtatgagctgttgtctaatttaagtaagcagtcatgggcttttcctttgggtcatgtaaggaaggtgactggggttagagcgttaaagtaatagacagtgatgtgtaagtgttaaagtaatggacagtgacgtgtaagggcaaagaaacaataattcataagaagtttggctaatagctaagaagcttgagggatttttgtcatttgcagggtctgtaaagtgtaaggaatcattaaggtcggtgtaaatcctagaactaaattaactgaagactctcattgctgatataggttttaggcaaggtgatgtatcttgactattgtaccataaaaaagactgaaattagcaataaacttctgaggattcctctatatttgagtcagtattcctagtgcttgtccagccctctcataaacaaaaggaaaaaggggtttgtggatttagaaaactggaagcaaggttgtttttttttttgttttcagatagttgtatcactctttgggcctaaataaaaatattctgcctttaactggaaaagaagagttttagatggagaagaaccaattagctgcctcctataaggagtctcttatgtgaaacaggaataagactataataatctccaataagaaaagataatgggactagaagctaaagttttaaaacaatataatttttttttttttttttactagttagaggtattcaaggatggaacaatttcttcattagaaatgaggaagaatagggtcgggcatggtggctcacgcctgtaatcctagcactttgggaagccgaggtgagcggatcacctgaggtcaggagttcgagaccagcctgaccaacatggagaaaccccatccctactaaaaatacaaaattagccgggcatggtggcgcatgcctgtaatcctaactagtcgggaggctgaggcaggagaatcgcttgaacctgggaggcggaggttgcagtgagccgatatcgtgccattgcactccggcctggacaacaagaggcagattctgtctcaaaaaaaaaaaaaaaaaagaaataaggaagactagtaaaaatttcaatcaaagcctggactatcatttgtttgaaataagaattcaaatattatttggatggctagaataaattattcaggctatttagaccaaaccattatatgagtgcacaaaaggctccagttgtaaggaacaggtgaatattctgaaaagaagggcaattcctgtgcttcaaaagccaatcatgtatatttatggttttgttttgttataaactcaagagaaagagatgaacaaaagtggttggtggctttccaatagggttaagaggaaaagagggaactaatatttatcgcatgtttacaatgtgccagtaaaataaaagggagatgctggaatttttttttttaaattcccaatttctatacagcagtatatagtttatcaatagcaaagaaagacaatttgaaaaagtaatggttattgttaaacctgctttattttccaccaagtcttggcaggatgagattcaggattagaacagaaggtttaccttgttcataagatacatctaaatgaaggtgtgggaggggagggctagaactgcatgttaagaagtatgtaagtgtatggaaacccataaagttaagagttgaagtgtatgggagtgaatttggatgagatttctttagagcaaaataaacattttttcttaataaatactacaggttgcttaatcagaatgacaaaacaggtaaagaggcaaggtggtcatgatggtgtggtattaatttcataaagctatctgttgctttggaggcatgggccccagtcttagcatacctgagcttgagttctagtatttgcattttatccttttcattactgacaaaatgagaattaatcaaacttattttaattattcaaagtaatgaaatgtatgtgaaaagcctttgtaaggtgtaagacactatgaagtgtttgttttggtaacaatgaagttatccagtaagagtcttattctgctagtcatggatatgcatgggcaacaatgtctgcctccccagattccagtcactcctctctattgtgttgcatcatgaagcttgagaggaatggattgattgattggtcccattccctaacccatatctcaataaagtcattggactgtaacccatatctcaatagagtcattgagatatattgcattaagccatgcctgaagccctattttctctctgggcattctagttttatgagccaataaatccccttcagcttgagttgaaatttttgtttcttgcaattgaaacaatcttgattgatgaaacatttaataaattttgactcactgacagttttatggaaaagaatgtaatggagaccaggaagaatactgttactctggatttaattctgattgataggaaagaacttgttaatgacatgtatggtaggttaaatgaaagtagctttggagtcaaatatatttgggtctaagccctcattccagcatttgttatcagtgttactttaagcaaataacttaatgcctttcagctttagtttcctcatctataagttgggtgtaataataatgtctatatcatcggagtggtaattaggattaatagataattaatagataacgcacataaaatatgccatagcacatattaaggattcaacagggattaggtttgaaaaactagaaatggaagatgcagaataaagacttaactgcccattattgccctatctctaaaataaactgaagacaataaggaaaatgaatgagaaagggagaaacatcatctttttaaattaaaaggcaacactttaagtgtgaaaatacactaattagaagagctaatgagtgtatctgaaattagatcagggtaaaggaagatgccaggagaggatgactacattatagagtttggacagagtcagcacagcatagatttctccataggggccaatgggtagctgtactttggaacataatcatgaaaggctgtaagtctctgtaacctccttgctgttacagtgtaacagaagaggcaaggttgaatgaggaaaccttaaacatactatctttggaacaacgctaattatgaagaagaatctgtgtatgacaagcaactctacagctatttacctttgttaaccaatgaagagagaaggtcaaatcaccttgcaatctcacagacacaaaatatgtactatgtagggcttcactgtgagctagagggtatccttattggcctagaacattcttctgaagccttatgcacactatcttcctaaaaataacttaaccaagaagaaatcacttaatttaaagagaaatattatttaaaaagcaacagaggatttatataaaacactacaatctgaaaatgaaataagaaaacaattttatttacaatagaatacaaaatacttaggagtatatttaatcaaggaggtataaaatttgtacaccacaaactataaaacattgctgaaagaaattaaagaaggccttaataactgtaaagacattctgtgttcatgcattggaagacttaatattgttaaaatagcaaactactccaaatggttgacagactcaatgcaatttctaccaaaatcctaataccctgttttttttttttgtttgtttgttttgcagaaactgaaaagctgattttaaaattcacatggaattgcaagggatccagaatggccaaaataatcttgaaaaagaaaaataaggtgggaagactcacatttttatatttcaaaacttactacaagctgtggtaacaaaggcattatgctaatggcataaggatagacatacagatcaataaaatagactgagagcccagaaataaacccaataatgataagcccaagaaacaagctcaatagaatagattgagagtccagttaattttcaacaaaggtgccaagacatttcaatggaggacagaatgatctacttgacaaatggtgctggggcaactggatatccatatgcaaaagaatgaagttagacctctatctcataccatatgaaaaaattaactcaaagtggatcaaatatctaaattagaaactaaactataaaactcttagaagaaaacacaagagtaaatctttatgaccttggacttggcactagattcctagaaatggcacccaaaacacaagcaatacaaggtaaagtagatacattggacttcttcaaaattaataacatttgtttgtaaaaggacatatcaagaaagtaagaagcaaatctaaaggatgggagaaaatatttatgaataatttatctgataagggtctagtatctagaataaagcactcttacagcccaaccccaaatagacaaacaacctgattaaaaattggcaaaagacttgaatagacatttttacaaagaagatgtacaaatggctgacaaacatataaaaatatactcaacatttttagtcatcaggaaattacaaattataccacttcacactcaactaggatggctgtaatttagaaaaaattaaaataagtgctggtgagaatgtggagaaattggaaacctcatcaattgctggtgggaatgtaaaatggtgcggccattgtagaaaacagtttggctattcctcaaaagttaaatatagaattataatatgatctaaaaattccaatcctagatatataacctaaagaattgaagaaaggtattctaataaattattatatatgaatgtttatagtagcattattcacaacagccaaaagatggaaacaagccaaatgtccatcagtgaatgaataaacaaaatgtgatatagctacaaattgttattattcagccataaaaacaaatgaagttctgattgaccttcaaaagctttatgctgccctctccctctccctctcccctttgcacggtctccctctgatgccgagcggaggctggactgtactgccgccatctcggctcactgcaacctccctgcctgattctcctgccttagcctgcccagtgcctgggattgcaggtgcacgccaccacgcctgactggtttttgtattttttcgtggagacggggttttgcagtgttggccgggctggtctccagctcctgaccgcgagtgatctgccagcctcggcctcccgaggtgccgggattgcagacggagtctcgctcactcagtgctcaatgttgcccaggctggagtgcagtggcgtgatcttggctcgctacaatctccacctcccagccgcctgccttggcctcccaaagtgccgagattgcagcctctgccccgccgccaccccgtctaggaagtgaggagcgtctctgcccggccgcccatcgtctgggatgtgaggagcccctctgcccggccgcccagtctgggatgtgaggagcgcctctgccgtgcagcgaccccgtctgggaactgaggagtgtctctgccctgccgccaccccgtctgggaggtgaggagcatctctgaccggccgccccgtctgggaagtgaggagcgtctccgcctggcagctgccccgtcagggaggtggggggcagcccccgcccagccgccgccccgtctgggagttgcgggggcgcctctgcccggcgccccgtctgggaagtgaggagcccctctgcccggccgccaccccgtctgggaggtgtacccaacagctcatcgagaacgggccatgatgacgatggcggttttgtcgaatagaaaggggggaagtgtggggaaaagaaagagagattggattgttcctgtgtctgtgtggaaagaagtagacataggagactccattttgttctgtactaagaaaaattcttctgccttgggatgctgttaatctataaccttgcccccaaccccgtgctctctgaaacaggtgctgtgtccactcagggttaaatggattaagggcggtgcaagatgtgctttgttaaacagatgcttgaaggcagcatgctggttaagagtcatcaccactccctaatctcaagtacccaggggcacaaacactgcggaaggcggcagggccctctgcctaggaaaaccagagacctttgttcacatgtttatctgctgaccttccctccactattgtcctatgaccctgccaaatccccctctccgagaaacacccaagaatgatcaataaatactaaaaaaaaaaaaaaaaaaaaaaaagaagaaatagaatagaataatataagtaagttacatgtgttcctctaatttgtgttcatccaggggaggcaaaggatggcaacaggccaaatccagcctgccacatggttttataaatacagttttattgaacacagcctcgcccattcatttacttatggtctatggctgcttttttgcttcacaatggcagtgttgagtaactgcagcagagaccacacggactgcaaaacctaaaatatttactatttgaccttttactgaaaaaagtttgctgacccctgatctattcatcataaacttctttttgataaatggattctaacagagacaaagaacttagggcttaccatcaaaacctttgaagttctgcctggttctgtatgtggaggctctcatggtgttatcattgcactcttttaccaatcccactgcttctgtccccagtaacattctaatcttggaggcaccaacaagatataagttctgattttctagtgtttcttgttcatatttatttaacaatggtctaaacaacaactgggcaccttcaaaaacaaaagataagcacaatcttagacaaacattaaagtttcaaaaataaaaactttctaaataaataaaaaaaaaagctttatgctaagttaaagaaaccagacataaaataccacctgttgtatgattctttttatattgaacatccagaataggtaaatttgtagtcagaaagtagactagtgtttacgaggggatgaggagaagtggagaacgactgtttaataggtatagaattttctcacagttagtgttgttgcaaagatagtatgtttaaccttacctggagctgagacaaatttaaagagccgagcgaaatacaggggtggaagaagcagtgggaagagccctgtgggtaatctcagtccccagggaagccatttgtgacttttttccacagaggtccttggggagggctgccagaggaactgggaaaagaccacagggaggaggaaacatccagctgaactttgtaacagttttgactgaactcaaagtttcctagacagaactcaggggagggagaaattgagagcacagacacagcacagaagcctaagcaggtgggaaggtatgaaacctgaaagccccgcttgctttctcagccaggaggctggtagcctggggcaagttctcagctctgctcaccctctgcctggaaataaacttggtcctgctagcggggcaccaaaagcagttggtgctgttggtgggggcaccaaaaggctgggagttagaccagccttttgggctttgtgggagctgggttaggccagtaactgctggctttcccccacttccctggtgacctgtatgacccagtagaggcagccataatccccctgggaacacaacttcattgccctcagaaccacactcccatctcccacagcagccttagcaagcctcgcgcaaggacagtctgagttcagacttgcctaaccctgcccccacctgatggtctttctctacatgccctggtagctgtagacaaaggacatattctctcaggagctctaggaccctgctcattgcctgaccctcacagagtccatttcacccccctactgctacctccaccggagcaggtgctgctatccatggctgagactccagacaatggttcacatcacaagactctgtgcagacactcccctgcccctgccccaagtaccagcccagagcccagtggcactactgggtggttagacccagaagagaaataatgatcactacagtttggttcccaggaagtgacatccccatgggaagggagatagcacacatcaagggagcataccatgggacaaataaatctgaatatcagcccttgagctccagattttctctctgacatagtctacccaaatgagaaggaaccagaaaaacaattctggtaatacgacaaaaacaaggttaacacccccaaaagatcacactggatcactagcaatggatccaaaccaagatgaaatccctgaattgccagaaaaataattcagaaggttgattattaagctaatcaaggaggcgccagagaaaggtgaggtccaacttagtgaaatgaaaaaaagatataagatatgaaagagaaaatattcagtgaaatagataacataaataaagaacaatcacaacttctggaaacgaaaaggcacacttagagaaatgcaaaatgcactggaaagtctcagcaatggagttgaacaggcagaggaaaaagctttggaactcaaagacaaggctttcaaattaacacaatccaacaaagacaaagaaaaaagaataaaaaaaatttaacaaagcctccaagaagtctgggattatattacatgaccaaacctaagaataattggtgttcgtgaggaagaagagaaatcaaaagtttggaaaacatatttgagtgaataatcaagaaaaacttctacagccttcctagagatctagacatccaaatacaagaagctcaaagaacacctgctaaatttattgcaaaaaagattatctccaggcacataggcatcacattatgtaaagttaagatgaaggaaagaatcttaagagttgtgaggcaaaagcaccaggtaacctataaaggaaaacctatcagattaataatagatttctcgcagaaaccctacaagctagaagagattggggccctatcttcagggtccttaaacaaaacaattatcagcaaaggatttttgtatccagtgaaactaactttcataaataaaggaaagatacagtctttttcagacaaataaatgctgaaagagtttaccactaccaagccagcactacaagaactgctaaaaggacctctaaatcttgaaacgaatccttgaaatacaccaaaatagaacctctttaaagcataaatcttacaggacctataaaacaaaaacacaataaaaaaccaaggtattcatgcaacaaatggcatgatgagtagaatagtaccttatatctcaatactaacattgaatgtaaatggcctaagtgttccgcttaaaagatgcagaatggcagaatggataaaaattcaccagccaagtatctactgtcttcaagacactcacgtgacacaaaaagactcacataagcttaaggtaaaggggtggaaaaagatattccatgcaaatgatgctaaagcaggagtagctattcttatatcaaataaaaaactttaaagcaacagcagttaaaaaagacaaagagggacattatataaagatgaaagaattgtccaataggaaaatatcacaatcctaaatatatatgcacctaacactggagctcccaaatttatgaaacagttactactagacctaaaagatgagacagacaacaacacagtaacagcaggggacttcaatccttcactgacagcactagacaggttatcaagacagaaaatcaacaaagaaaaatgcatttaagctatgtcctagaataaatgggcttaacaggtatttacagaatattctacccaacaactgcagaatatacattctatttatcagtacatggagcattgtccaggagaggccatatgataggcctcaaaaacaagtctcaataaatttaagaaaactgaaattatatgaagtattttttatgtaataattacataattttatgtaattttatgtcttgggtttccacacttactatcttatggaacctgttcccttgaaggtcaccagtgacctcataatggttattttagaaagcctttccccccccataatggcctttttagggtatagctatcatgcaataaattgaatatatttaaagtacacagtttgataaattgtgacatatgtatacacccatgacgccatcaccacaatcaaattgattaacataaccatcaatcacaaaagtttttttgtgccctctcatgatcctgtttttctctttttgcccccgtcttcctttcccaagcaaacatgaatgcactttctgtcactgtagattagtttaaaatttccagaatttctagaattttatgtaaatgaacaatatatacttcttttggtctattttttatttttttttactcagcataatcattttgagattcttttatgtcatgtcttttaccaatggttcactcacctttattcctgagtagcattccattgcatggctatatcacagtttgtttttccaatgtataagcacatggttgtcaaaacaaagtaaagcatagggaactaacttaaaggtgcatggaacaacaacaatagcacagaaataaatgctgctatgcctaagaatctaatatgtgataaaaaggagagtataaatcaataaagtaggcaaatttaaaccaagtattttgaagttattaaatggataaatgaggcaaaaaatctaaataggcccctcacttcactcaatatagcaggggtaattaagaagaacaatgacattattaagattatatagtttacatttattaaatcagttgtgacatgatctccttttagaaagattatttagtcgtggtgcgaaggataaactagaaatagtaatcactgaattatggatgccaaagtaaggaggttatggtagcattaggatcatgagttaataaaaacaaggcaatgagaatggagaggaaagggaaactatcagagatttcaaaatttcagaggaagaaatgatagggggaatcatatttttctaactgcaatttaatagaagcaatcccttaacttttttccaggcttgtcttcaggtgatagagacttgtaatttctcttggaaaaacattttactaggtgactaggattcaagctgtaaatcttggttaatcacaaactttatgagtttagattagttgtgtaaccttctggactgtttgctttctctcctgtaaaggtcaactctaagacttcttacaacttcagatttcttggataataatttattatcttgaactgcatctccaattgggcctaagacaacagaccaattcagtgggaaatgaaaataataaatgaattgtatgggctaactaccactcacagggccttagtgaagaaggtgactataatctagattaaaagtctttccacacggtgttttctcttaatgatgaaggaagctgtgcaggcaggaatagggttacagggtactaattcgcttctgctctgctgggttgaatggcactcaagaggttgagtgtttgtaatgaaacacacacaagttctggaggcaagaagactagagttttgttacttttgacaagttacaggtcaatagagactgcctcttaagaagacctagaggaaaatgcaactttttaattaatctcctgtgtttctctggctcatgccattatcatagataagaccaagggatgcctctggtgattcattagaactcttaggctcactgattactctttggtctctaaatgcttctctgtggtaagaagagtagttaacaaaggaagctgggtttccccagaggaccttattaaaactgttgtggttttgaagtgattaacatgtaaatgaattaatgtggtcaatgaaccaagctatgcacacagagcatatctaggaggcagagaatcatacagtctagtcatactcaggaggaaactgtttagcattcagaggtgaattctggaagaaagatgaaaaaggaactcagaattactgctttaatttcagaaacactaaacatgaaatgacagaagattagaagatttttgtagagtttgtacatgttgctttagaatagattcctggagcaaaagtagaaatggcttaccattagagcaagcaggttagctcaagaggctatactaagctacttttgcacacctggtggcaccacatcctatttgcagtctgcaaacatcatcacctcccttaaatgtgacacttgttatatctcagaggcaagttaatcttactcaactgtatagaatagattagagggtggagagagctagctgatttaaactctaggtgaatgttagaaacaaatactgaaattgaaagtcagaaagagaggcaggttttgtgtgaaaagcagttagattttgacttgtgtaataataagatctcttgagtaaataaaacaaaatttctcttaggagttcatcagtttcctttgcagtcctaactcactagggatgtcagagttagggtcattatagcattctttgtgagttacagttagttgtagcctgtttgcatttactgatttttatgagataaagttgctttactaccatttgcctacaaattgtaatggaaattaaaatctatgggtctgtgatgtgaatagttctcctggggttggacagtgcacacctgcatgactataggcaaaaccatgtcagatgagatgtttatttaaaaataaatggctcacctacttccctaaaatttttctttgaaatgactaccaaagatacaggtaggactgattgagaaaaggcagaaattgaaggtctgaaaagagagaaaagtcaagaaagaagaataaaaagatgtagtctgggaagtattaggcaaattaggcttgagcaatattatgaaagttttcagcattgttcccttataattgcaaaatgggaagtattgtcacctctttcattttttggaagagtttgtgaaggattggggctaattctttaaacatttgatgcaattcactagtgaagcttcctgggcctggatttaactttgtggaatactttttgtttacttaattgatcttgttatagatctgttcggattttctatttcttcttgagtcagttctggtagtttacgtctttctaggcatttgtctttctcatctaggttatccaatttgttggcatatgccattgttgttcatagcattcccttataatcatttttatttctgtaaaatttgtaatgtttctattcctgattttagtcatttcagtgttttctctttttttttttcttggtcaatttagcataacaaaaagtttgtcaattttcttgatcttttcaaagaagacatttttggtttaatttgtttttctctattgcttttataatctctatttcatttatttccactctagtctttattatttccttccttcttcttgctttaggtttagtttgttcctttatttctagtttaaggtaaacagatgattaatttaatattttttctttttataatttggtgtttataaatttccctttaagcactgctttagctgcatatcataagttttgttatggattttttgggtgtgtttttgtttcctttaatctcaaattattttcatatttcccttatgatttcttctttgattcattgtttatttaggagtgtgttgtttaattttcacatatttgtgaatttcccaaatttcctttttaacttttagtttaatttcattatggtagaagaaaattatatagttttaatccttttaaatttattattttttccttttggttcttttgttctaatttctatctcttcattgatattctatagttagtgagccataattcttatagtctcttagttccttatttgtgattttttaaagttctttgaacatgtttgaaatagctgatttaaagtctttgcctcataatttcaatatctagcttcctcaaactttccttttctttgtttgacttttctgtagaccatatcttcttgtttctttgcatgttttgtctttttttttcatggaaaacttgttatggacattttattttacttttgccttgaaacattttatttatttatctttaaaattttatcattttttgggagatatttaacattttaaataatatggcaactctggaaatgtcactcaccccctcggggtttgttgctgctgcttgttattgtgtttgctatcagtttgtttactgactttcctgaatgcatttgtaaaacctgtattctttgtcatgtgtggccattaaaatctctgcttgtttagcttaatggtcagctaatgattggatagagatttccttaaatgtctggaatcagtaggtctcttatccttcactgatgggctttgtgcatgtgtttcaccagaccttcaatatttagcctggcagtttgcaactctgccttagccttcacttcttgctctcacagagcttcaaggtcagtcttaggtgagatattaggtacttcttagatctttcctaggtcttcaagtggcctttggcgtgtatacagccttctgtgtgcttctgcatggctttctagagtttcaggaatatgttggagtttttcagagccccctattgacatttcgttattcagcttttcctttaagtgtattggtcagtttcttgtttgttccaccattatcatctcctcaggcagtggcaatgttaaataattggtgcttattgttttccacctcctcccctccaaaaaggttgtttgcaatgagcaagttctgaataagatcaaatacaggcaagtcttgccaatggaggttgcaggaatatgccagacaggtcaaataatgacagtgctctgagaatagtgtttttggggagctccaaaccagctttgccctgtctagtagcttcaaggctgctgtttctcaccattatggcagtgctgttggttttcaaggctattggagagctggggagaagaagacgagaacaggacaaattaaaacaccacaaagttgctgctcactgttcttatctagatacagccagttttcatgagtaaatgcttcttgaattattgcaagtcttttgttaatttccagagttcagaaaaaaaatatttatttatttattcattgtttttgagatagagtctcactctgtcacccaggctggagtgcagtggcacgatctcagctcactgcaaactctatctcctgggttcaggtgattctcatgcctcagcctcctgagtagctgaaattacaggcgtgtgccaccacgcccggctaaattttgtatttttagtagagacagggtttcaccatgttgcgaggctggtcccaaattcctgaccttaagtgatctgcctgcctcagcctcccaaagtgcagggtttataggcatgagccactgtgctcggccagaataagttattttgacaatttttttggccagtgttttcattgcctttgtgaagaggtggtttttgattgttatgctgctattctcactgacttcactcatgctattctgtcatgcctcaatcaatcttcatcacagagcacagtctcttcatcatttcccacaaaatccagttacagcaagtaattatttttcaatagactttattggagtctatttgaataattggcagataaagtcccatttttgttgtatgttactttttgccatcttggagggttttaccattttttcctttacttatctcccaccctatccccagatgcctctccctgtaatattaaacctattctttcttctttgatcctacttggtgttattttcttctctaatcattgtccaaaaccaatgaagttctcttagaactttggaagaattcaaatgaattagaattatattttgttataaatattaaagtcccaggtaagttgcatatagatcatttcaaaatgtcttttcaagctatccaatgacattttggctggctgctgcttgtgaaaccaccaagatctccatcctccttctttctttctttgtctctctccacctgaattaatttttgtcctttcatagatgagacctatttttttttgtaacttggagagaggtgagaaaatttggatcagtaaaaaggctaaggtgaagagatgagaaaatattggaggaggaaggcataccatctgttctccacttgtctcctcatactgattttgagccccctgtagagacagaattttagagatagaagtggattgaaatatgttcaaaaggagctttgtgagatgtacagaaaatacactctcttttccagcactaatggacattctaaaaaattgggcatgtattaggctacaaaggaagcttcaataatggagacattgtagctgcattctctttttggtcagaagcaagacagggataaccactatcagtgctactctttgttattttcctccagtagtatgtttgcagaaatattctttagtgtatacatcagatgatatcgtttggatatttctccccactcaaatgttgaaatttaatccccagtgctggaggtggggcctgatgggatgtgtttggatcatggcagcagatccctcatggcttagtgctgtctttgtgataatgagctcttgtgaggtctggttatttaaaagtgtgtgacactttccaaccccaatttgctccttctttcgccatgttacatgcatgctgcttctttgccttctaccatgactgtaagcttcttgaggcctccccagaagctgatcagatgccaacaccatacttcctgtaaagcctgcagaactgtgagccagtcaaacctcttttctttataagttatccagtctcaggtatttctttatagcaatgaatgaatagctaatacagtagggactatgcctagcactttctaggcagcaatggaagggctttgtatattcagtagtgagtgttcttgttgttggttgagtgaatttgtagtgttagggtgagtagtgtgagatttgattgattagagaattccctgtgctgtgtttaaacattgtttttggctgtatagcattgaattctcactgcctatctctgctggagagtctgtgatctatttaatatatcttaatatctttcttttctacttaaattagcttagtagattttattaagttacatctgaatatttgactgacaaaaagaggatcttgctaaagctaagatagtaaaaatagtatagtagtattgcagagaaacaacaagatgaatataaaactcaggaagttcaataggtacatttgtgaatcaagttcataggtgagtctaatatgataacgatgatgccacaaatctttagggaatggtggattatttagtagattgtgctattaaaactgtcctgctctatggagaaaaataaagtagttgggtcttctacagatgtaaattttagatgaattaaaacctaaatgtaaaaaacaaatctataaagataataaacacagtgtgggaaaatgtatttgtggctttggggtgaagaatgatttctaaatcaaaatccctaaagcccaataaggtgaaaaaaatgataatgttgattccttcaaaattaaggatttccattaaaaaaaaaggacaccatagacaaagctaatagactgggaccatattagaaaaagatacttgtgattttggatacagcaaaaaattaatatatgagaaactcttatgatttactgagaaaaactagaggtctaattttaaagtgagaaatcatgtatatggataacatgggaaagggaaatacaaatggctcaatagactaataatcagggtaatgcaagttgacattccatactcagtagattggtaaaagtagacagttttataatactaagtgttgttgaggttatggaaagactggaatgctcatgcactgctcgtagaagtgtaagtggctgtagctactttcaatcattaccgtcgtgaaattgagtatgtgtatgtactatgattgaacaatccttgctggggacatatcctagagaaattctcacatagttaataggtgaaatgtaaaaaaaaaatgttaattgctgtgtttgcaggagttacaggcagcctataattccatcactaggggattgcctaagtaagtgtggtgcatgctgaaatactgtgcagtagttactttgaaccaaaagtacataaccagtatctaaaaagagttttaagttatctgtagctctgtactaattggcttcagtaagaagctgcttaaagccttaatcagcttacttgtcaaattgtattccttttgtgttcccctctgtgttttggttgtcagaaatttcagagctcaaattaatcatagtagcgatcttagtccttccactaaatatatctgtccacttccctttgatttttctatcctcattttagaggcatttttgaattctgtattttatttggaagctttttgaggtcgtatatataaataaaaggtttctgttggacctaaatgatcatcttatcattattattatttttatttttagatggagtcttgctctgttgtccaggttggagtgaagtggcgcaatctcggctcactgcaacctctgcctcccgggttcaagtgattctcctgcctcagcctcccgagtagctgggatcacaggagactgccaccatgcccaggtaatttatatatttttagtagagacagggtttcaccatgttggccaggctggtctcgaaatcctgacctcaggcaatccacttaccttggccccccaaaatgctgggattacaggcttgacccactgctcccggctcatcttatcattattaaggactctgtcattaagaaaagagaaaagattaggaaagaaatggatttcctctcacctagaagactattaaagaaaggaaaggggatgcataaagcaaccatctgaagatggaaaaagaagtgtgttactccatgaaagtatgtgtttaatagccactcacctgaatgaagaacatcttttagtattcagaaggcttttccaaaaggcagttatttcctctggatagccttcatattcctatggaaattgaataaggatgaaaaatttgaacaaaagcaaaggacatgaaatctcttgaagatatgagaagctgtgaacacttgtcttagagggtgcatggagaaattatttttcatgagttcccatgtagtccgctaggtggcggaggttacataaaaaccctactgtataaacactgaattgctacacacttgtgtttcctcttctttttcaagtaaaatcccaaggaaacctgtagagtataataaaagctggagatagaactttgtagtaagccctatattaataacaataacagtgtcaggttgcaaaatgaggataggtaccataccaaaagagatgatctccaaatgcagtttttgtttcttttgtttacagaaaaattacaactgatttttttttccatatttgttccaaagatcaccttgaatgcaaggaatcaaattttgatcagtatatttacacagtaacttttgtaccttaaaaaattcatttcttatctactgcagctactaatatctcacgctaattattttaaacacattagcaggtcatcatgtcatatgtgacgggacttagcatactttttgtgtgactatatcactttaatttgtgtgatgaagcagtgccccattaattatgtgactccttctaatacccttagagaagaaaggaagctccttgaatactaaatttgcacaaccacagtgaccttataaaggatgcattcccttttaagattaatttctcagaacaaagcacagtgacgtcattactaagcagcctcacaactgtagcaacccttctaaaggttgtagattctggctgatgatgtcactgacacaaaggaaaaaatgcaaaacaggtagtcttaaataagcattctggtgagaccaactgcattttggccatggctttgcagagcactctgggggcggtgtggctagggcttctcctcaactctctctggaagggtgagtagcctccttcactatttggttttgtaaaagtgtatgaaattgttttaaaatttggactcatttttaatacaaaaacaagagaagtcagatctaacattcactgtacctaaggggcaatcaacaagccaaatagtactattaaagtgacagccctttttgttttctgtagttgcagaaagcaaggaccaagtgtttcagccttccacagtggcatcttcagagggagctgtggtggaaatcttctgtaatcactctgtgtccaatgcttacaacttcttctggtaccttcacttcccgggatgtgcaccaagactccttgttaaaggctcaaagccttctcagcagggacgatacaacatgacctatgaacggttctcttcatcgctgctcatcctccaggtgcgggaggcagatgctgctgtttactactgtgctgtggaggacacagaggcagggaacccatgaagagctgaacagaaacagagatcacagcctttgcaggaggcaaaacagagatgagcaataactttttcctccttaattcagtattacccaagctttttcatttggtactgctattaggaaaaaaaattgagtccagacatactatatattaacaaatgtctataaaaatatgcttttaatttttttttgagacacagtcttgctctgtcatacaagttggagtgcggtggcatgagcatagctcattgtaacctcaaactccagggctcaagggtagctgggactcagccttctgactaggtgagactataggcatgtaccaccatgcctagtgaattttcctcctttttgtagacacgagttctctctgtgtcatccagactggtctcaaactcctggcttcaagtgattctcctgctttggcctccaaaagtgttgggattacaggtgtgagccaatgcacctggaccagaaaatatgtttttaaagggtgattatttcaaatagtcttcctgatatctgaaacacttttgactcattttcttgagatctgattagattatttttgtttttccctcataaaatggctgatgatgaacttgtgatagtagtaagaggcatgtccactcttccattttcttctcttttttaaaaattcagacaggctggagtgcagtggcatgatcatagctcactgcggccttgaacttctggcctccagtgatcctcctgccttgacctcccaaagcactgggattataggtgtgagccaccaaggccagtcaactctttcattttcttattgctgtctgtgcttaccttttaaatactatctgctaacttcagtctttttgcagcaatattttcaaaacatgtcaatttgtaaaggatggtttagttaacattgggtaatgtaataagaagtgagaaaggaaggaataaatgagtggctgatacctacagccctgcatttgaaatctcaatccatgcctcagtatactttgcttataatctagcatacagtcctgttgagggtgccagtcaatgagtatatgaaatattagtcaaactgaatctccttcataatatttaaactaaaaacaaatgcaaatggaagtatttgtactcattgcaatgcattcttcccacactcctgttaattagcttggtcctcccaccccagatgtgtccctcccactttagagaccaatgccttagggtagcccagtggttcttaatatattttatcctcctagatcggaagttttgtgaaaattggatttgttttcttggggggccatattctagataaactcaatcagagtttgcaggggtgggacccagaagtctatattttccataaagctctgctggtgattgttttgctcagccagggttgatctgtgaatttcagattttggaccccaggtgtattactccattctcacgctgcaataaagaaatacccaagactgggtaatttataaagaaaagaggtttaattgacttacagttctgcatggctgggaaggtctcaggatacttacaatcatgatggaaggcaaaggggaagaaaggcaccttcttcacagggcagcaggaaggagaagtgccagcaggggaagtgccagacacgtataaaaccatcagatctcgcaagaactcattcactatcatgagaacagcatgggggatgccatctccatgattcaattacctcccaccgggtccctcccacaacatgtggggattattacaattcaaggtgagatgtggatggggacacacagccaaaccatattaccaggtcttgaggctttaaccactattctctacttccttttaggtagaattttagtaacagagaagggcttcaggaagtgaactgtacagtgctattgcttgcttacacagtagactttcagcaaatgctgacatttggaataaaaagtgaagggcaagatgggcacgatgggttatacctgtaatcccaacatttgggaggcggaggtgagaggatcccttgagcccaggagttcgagaccagcctagtcaacatagtgagaccctgtctttacaaaaaataggaaaaattagcctggtgtgttggcatgtgcctgtagtctcagctacttgggaggctaaggtgggaggattgattgagccagggaggttaaggctgcagtgagccatgagggcaccattgcactccagcctgggtaacagcaaaaccctgtctcaattaaaaataaaagtggccaggtgtggtggatcatgcctataatcccagcactttgagaggctaaggcaggtggatcgcttgagctcatgagtttgacaccagcctggtcggtactcaaaataccaaaaattacctaggagtggtgtgcacctgcagtcccagctacttgggaggctgaggcaggaggatggcttgagcccgggtggcagaggttgtagtgagccaagatggcaccactgcactccagccagggcatcagagtgagaccctgttaaaaaaaaaaaaagaaaaaaagtgaagagcagattgctgatgacagaagaaaaaaggtattttagtaatatcaattgtcatgaaactttgccaaaatgtcataagattgattcttaaatgcaaatttttaataacacccaaatatttccattggatataagtgtaaattggtatgtttgtgcttgtattacttctttaggcatattatattttgggttgttgcttgcttaaaagtgtgttaatcttattttttaaattttatttatttattttttctaagatggagtctcgctcttgtcacccaggctggagggcagtggcgcaatctgggctcactgcaacctccgcctcccggcttcaagcgattctcctgcatcagcctcccaagtagctgggattacaggcacatgccaccatgcccagctaatttgtatttttagtagagacagggtttaaccacgttggccaggctggtctcgaattcctgatctcaagtgatctgcccgcctcagcctcccacagtgttgggattacaggcgtgagccaccacgcctggcctaatcttactttttaatcaaatgaaattcttgagaagaggaagcatatgtgatccttctttcaggttgtcctgcatagttctgtgtgcactgtagtggctcaataaatcatgaacacaggtgtgacctcattgctttggcaagagagaccagagacagaaaattccctttggttacattaggaagttctttccagttcacagaggagtctgtacatgtggtatactgaaaaccctaccttttaccctggtgttttgattctataattcaaactgtcaacaactagtcttctaccagattttttccagcttacatgaagaacactaaaggcattattatccaaaggggaaaatggaaaaagagagtgaaataagaggaaaatgcagttgatgcatttttcttacaacgaagagagcagccatgaagtcccactcttaaagttataacattatgaagctcccagttcagtggtgacaaggacagaaacatccacaggagaataaattttttttttttactcccaatcctgggagttcatatatatgaatcgaaaggtaactgtgtctgtcactggctccatgagaaatctgaaagacttgccatgccttgctactgtatcctacgtcctctgacttcactgctagttttcttttcttttttttttttttgacggggccatgaaaaccacctacggtaatcttctgtaccttctgaaaatcatggcgccacagagaatggggggtatttggaaggctgtgttgctttcattttcttcctaggattagtgttatgggttgaattatgttccctaccccttgccccgcaaaaggatttttttttgagtaggtgacacgggtaagtcctagccgtcagcacctcagaatgcaaacttatttggaaatagaatctttatagtggtgataaaattaaagtgaagtcaaaaggatgaaccttaagccaataatgactggcgtccttataaaaaagggagatctgaacacagagacagacatgcacagagggcagacaatgtgaagaggcacagggagaagatataaaaaatgtagtatttttcagaggtttgagatagcatggatatagctgggaccagaacacagcaataaactgtgtggggagattgaaagtcagatgtgaattaaaatattttgcagatgcttgtgtagatagataatgatctcaaggtccagtttacatttattttccctgtgataccttggaactacataaattgcctagaaattaggcgtaatctcaggaaaaggtaggaaaactctgatttgactgagatttggtttctgatacctggtagactatagctttaaatagaaattaaatatagttatgaaaaaagtttttttccctccttcagcatctacttttgtgtattgaaattatacttacagatgatttaaaactttgctttcttggaaatgtatgaaatgatgatgattttggtaaaagggataatactgtcttaaaccacataaggggaagacactgtcaataggactctcatggatgaatagtattccctttggactcatttttgaaaacctgaacaataaaatagaagatttaaaagctacacataaactctcacaaattcatctgtgacatcttttgcatgatctttgttctagtatttaactgaatttttccataatcttctatagccattttctgtcctgctgttctacattcttttaccagattatctcaaaatgtatccttgattttgttattccataaataaaatccttcaggctttttaattttatatataagaaagaaacaaaaagaaaaacagcaaatctaaatagaagtaccctctgcttagtaaagctgtcatattatgaacccaatgaaactttgctgctttactttctgctgctacatcccctatccccttgggtcaccaaataagtttattctctagcctttaagacctgttggcattatctcctgtatgagttgtatcagattattttctctgcctgaaatgccctctttctccctttattcagattgtagcccaacctctataacttcttcagctgaggactctctcccttgtttgtgctgctatagtataatgatccccaaagtgtttgactgtgtgctattatcagtaaagtatgttactcctccaacatatgcatatttatatgctcatagattatgatcgtgtgtgcaacaaacaaaaatagaaattaggaaagtttgagataaatttaatactaaatgttgtgattttcttctcgcacgcagggggatcatcttgtgtagcacatccgtgtcccttctacaagatgaactaactagactaacttggtctttaactagttggctaaatttcttaaactttgtgaaactctttcttctctcatttgcaagaaatatctgtaatgatttttctattgatataattcttgcacattttacttcagatagttaactgttcttcccctaagtgttcatctaccaaaatggatggtaagtttctggagggcaaggattatgtcttgttcctctgtttatttctcaatgcaaatggtatcttacatttaacaggtactgaaaagtgatttgtgaggatcaatggattcacagggttttctcctggaattgtcagaatgccaaggcagttcttaagtagattcctggatgaggaaccctctctgcaaaggacaaccatttgtgatgaatgaacggaaacagagctcttagatcattgcgtataagatggcctctcattacatggatttctgctagctctgtgtacttatttaaagtttcaatcatctgacagttatttattgggtgcccataatttgccaatcacatgttttttttctttatatctgtcccataaaacaaaacaaaacaaaacaaaacaaaacaaaacacccatcctcagagcttctctacaatagacacacaccaaactaaaaataaaaatgcatgaatctcaggaagagaagttctaaaaaacaatctagaccatctgcccatgggatgcttgattttctcaacagcatcacatcaagggaattgccaatattttcacaacagcttcttgcaggagggttcttgctgctcccatactgtccattcaaactccaggcggctgtgagttgaaaatctattattctttatgttgaggaaacatctgtgttcctgtggcttctacacctttgggaatctaaaagagttcacatctctcctttacacattttgaaccagatacaacatttccacagagcagtttttttccatattaaatatttgtaagtttcctaaccattatatatatatatatatacacacacatacatatgcgctacaattttgatttccctctttgttgtacattttaaaccgtttccagttggcttgtatttcttttaatatagaattcttagaacttaataaaacacttcagatgtggcttgacctattttaaactacaaggaaagaaggaggaaactggatgaaggtgaggcaaggtaaatatattaaacccagagacactacacaaatcttttcattccactgagacatggatggccactgattcttgatctcctttgtttggaggtaggagggcagaagttcaaattacagatttgcccccacctttcttttgagagttccctaacttatgtgaagtatgatttgcttagttggactgtatattttgtcagtttcatggaaaaagcactgatttctttgttctaacaactttattttgtgctgatttttctttgatacttctaaaataaatgtaatgtacatttcagagtctaatatttgcaaagggatttgtcattagtttacatgagccatttcttgtctcttgtgaaatcaatgatatttacagagttctgatttttttttttttttttttttaaagaaacaaggtcttgttatgttgctcaggcttgccttgaactcctggtctcaagggatcccgcccccacccccgccctgtctcagcctcccaagtggctgtgactatagtcatgtgccaccgtgacaagctaagagttctgatgtttgcaagtagtttcttgagaaaggcattggcagccttggtgaggcatctggagtctcagactgatactccttgacactgctctgtgctactctaattgcccttgtgttgtgatgtgcatgtttcagtggtagttaaattaaggagtaaaggaaactaccctgaggggagcacagacatctacctgcagcattttgggcacattccccattggcccacccatctcatatttgactgacctctaaatggatagcactacacccagtttactatggtttggagaaacagttcatgtcaactttctgtgaatgtcatggttctttcaatagaaatcggagagttggacagaatagctaaaaggtggtccagactgggtgcatatggcaaattgataagaaagagtcaagttttcatcaaactttctgtacataaacctgtaccagcatagcagtgagcaagaggtgcaggagaaggtggatgacctttgagtgctggtgatttagaattaattatccaggagttgttttggttcagtggcacatacatgtgggatcggcatttggtataatgcactcaatggacaatatgacctctaaagttctatttaacttattcaagcttgattctgtaattttattatgataaggaagctgctttccaatattatattgtctttaatagaaagcaaattaccaaaattgatattccccctatatgatttaaaggaatatgcctttgaagtcggtaaaatatgggttaaaaatctttgttctttttcttaaggatgatgagcaaattattcaattttcctcaactgtggtcccctcatctctaaaatggggcatcttaggaagagtaaatgtgacaaagaatgtaaagggtttaatgttatgctcacggcgacatttgatgaataatttcttaattaatctcagaaatcaaagcagataagctgaatagctactgaggctatgttgttcaattttgaaatttcagtctaggcccatggaattctttgggtgctgctggttactttgtgtgcagtgcattatgtggaggtccctgaatccttctctatctgctgagcagttaaaaggcagttctttaactggaagcaaacacgaagactaaactgtcctagttttgaggaagaataagaaggaggaggaggaggaggagaaggagaaaatgaagatgaagaagacgagaagaagaagaagattaagaagaagatgattaaggattctgcaacagttctgtcattgcaaatgactacccatttctaaccacgacataaattcagaggaaaactttcctctttctatagctgaacatgcttaattaataaatatggttagttccttccataagtatcctttagggggagaccactaaacaatcaaccatttctagcacaaaattaaaaatatcagtctcctaaatatttagttcacttgaggctcttggcattaattattaaatggatgaaggcaaacaatatctcagccacttgcacgatctaggcataatcttgtgtgctgtatctgtagaggtcagaggaagtagggattggaaaaataatcaaggcactgaagtctacactagactactgttttagttaaacttattttatttgcttttttatgttgatcatatcatatgttgatatatgcccatatatgcgtttatagggcagcaataaactccagtgtcaggaggctggacagtctctgttttcctcttcaggtctattctatcctgctctgtactaaagtctatattagactattgttttaaacttattttatttgtctttttatgtttgtcaaaatgcagtatagctatgcccgtatatgcatttgtagggcagcaataaactccagcatcagagggctggacatttctccattttcctcttcaggtctattatatcctgctctgtaccccaggaggctgacttctatacgttatgtggactggtctcccatgtccattggcatctggttgggtttaccccagtgggaggtattagcaggagagagtggtcaagatatttgcattttaggatcctttctttcctctactgaagtttacagctcctgttgggtctacccagaatatggtcaagaagaggtatttagactgtaaagggtcatgtcgcctttggcctgtgattagttacaggtgtcctgagattagggtaatttcatcttctcccgtccctttgggcctaggagtggtgaaatcttctggctgttattagccccaggtgcttcaccttcccttgtagttttccctaaattttgcacatacacttaaaaatattctttttgttaagctttttttcaatgattttctcgaggcgattgccaggaccctcaaaaagacaacactaacactcattttaggcttgaggcagagagagaagaaagagaagaaattcactatatgtttccatttatgacaagtctctctggaacttgaagattattgtttaaagacagtttaccaattccaaagaaaaacattattatatggctaagttttcaatgattaaatatgagatctttagcaaagcttttagaaagaattatgttccactttttttctgattcaaagcaaagagatttttcatcctttcctcagaatatatagtgaacattatttggacactattcaaaagaaacagaaggcaaatcagaggaacaacttctttatattgatacatgctttttacattaaaattaaaatctatcaaagaatcactcagttgctattgttgcctttttttagtataaaactttagcatgccatccctttccaatgaaccccttttccccatcataatacatcaagtttcgttaaccatacattttttgctgaatacgtacttcatttgaagtctgttttaagtaggctctgcatgtggaaagtacctgttttgcaaccccttctcagagtttcatttttttgttttatatgtactgtttaatatgacaaatgctccaaaaatatttataacacctattcgtacttttctcactctaaaaatgtttaaagagaagattcaagtttctttttgccctaaagatcattatgggatgggctcctaataggcccaacgtggagaaaattctgagttatttttggtcaaagaggtttacacagaagccagctctgaattacttctaacgagaagagcaaggctcctgttttcgcctgtcatttatcttctcttgccttactcttttctcctattttgctttttcttatctctcactttaaatttttctctccctcttgatgcaaagctatattttcctttctttttctgtgcattttcccatcctatttcccttctttctgtctctacattatcttaagagagcacaaatcatttacagcttgatccactcagcctgaatcttttccactttgattcacaaacttctatttcttctcctttgaacccctaatttgctccctatgtccctcatggagcgtgtaaccatccaaaggttggcccagggataaggccaggaagcaccagctgcttgacagtaaagtcgctggtcctacgtgtgggctctagggggcgatgcagtgtaaggtctgtcctgggcataggcggagcggcagtcttgctcctcacagagctttgaggagctggatcaaaattgtgctccacagagagaagataccggtgtcgggaagcaccagtgccctgaggaagggccatttccaaaagccctgtgctgacacagggttgctggttcctcttcaagagcccactctctggggtggggccatatctccagcagaggtgggctggaaaggacccccccaatcccgcccgccgtgagcttagctggagccatggcctctgcacccatctcgatgcttgcgatgctcttcacattgagtgagtaatatccccttcccattttccactcgcatgatccacttacatgctctccagcagcttcactgatgcagcatgattaatttacaggtgggctgagagctcagtcagtggctcagccggaagatcaggtcaacgttgctgaagggaatcctctgactgtgaaatgcacctattcagtctctggaaacccttatcttttttggtatgttcaataccccaaccgaggcctccagttccttctgaaatacatcacaggggataacctggttaaaggcagctatggctttgaagctgaatttaacaagagccaaacctccttccacctgaagaaaccatctgcccttgtgagcgactccgctttgtacttctgtgctgtgagagacacacactgataggggctgcagggggagcagaacacaaactcttgagtctggtaaagcccattttcttgaagtctttgttccttcacatgagaacggtgtgcttccaggatatgtcacttattatgttaaactacaatttaaaaccatagaatttgctcattcagcaagtgtttattgagtcctgatgtgccaggtactgggcaaagcaccggtcataaaaaggtgaaagaagtgtaaaacaaatagaaaaaaacataggggaaaattaccatgacattggtctgggcaagaagttccttccttccttccttccttccttccttccttccttccttccttccttcctccctccttccctccctgcctctctctctttctttctttctgaaaaggggtttattttcaacagacatttctttttataccgaggtgaaatgtcatcatcataataattttgcaatgttacataccctgttgagaccattaaaaaattaggttcatggtatacacgtccaagtttgttacaaaagcatattgtgtgatgctgtggtttgggcatctattgatcctgccacccgaagagtgaacatagtacccaggagaaagcttttcatctcttgtgagcaaggaatttttggatatgaccccaaaagcacaggcaacaaaagcaaaaatagacaaatggggctatattaaactaaaaagcttctgcacagcaaaagaaacaataaatagagtgaagggaaagcctatggaatgggaggaaatatttgcaaactctacatctgataaggggttaatattcaaaatgtttaagaagctcacataccaaaaacatccaaataacctgattaaaaaataggccaaggaactgaatagtcgtttctcaaatgaaggcataaaaatggccaagaggtatataaaaaatgctcaacatcattaattatcaggaacgtgcaattaagaccaccattagatatcacctcacaacctattaggttggctattatcaaaaagacaaaagataacaaccattgttgagaaggtgaagagaagggaactcttccacactgctggcaagaacgtaaattccataatgtgcaaccattatggaaaacagtagggaggtttctcaaaacaccaaaaatagaactactgtatgatccagcagtctcactattgggcatatatccaaagaaaatgaaatcagtatgttaaagagatatctgcactctcatgtttattgcagcactattcacaataaccaagatatggaatcaatctaagtatctatacttagatgaatggataaagaaaacatggcatataaacacaataaaatactattcagtcttataaaaggaagaaatcctgccatttgtgacaacacaattgagcctggaggacattatgtcaagtgaaataagccaggcacagaaagacaaataccacataatctcacttatttgtgtaataaaaaggttgaatttatcgaagcagaatagaattgtggttaccagaggcttgtgaggggaatggaaagggattggagagatgttggttaaaggacacaaaattttaattagataggaagaataagttcaagatatctactgcaatggtgactatagctaataataatgtatttgcaacagaattttttttttttttttgagacagagtctcactctgttgcccaggctggagtgcagtggagtgatctcggctcactgcaacctccacatcccaggttcaagctattctcctgcctcagcctcccaagtagctgagattacaggagcccgtcactaaccctggctatttttttgtatttttagtaaagacggggttttaccatgttggccaggctggtctcgaactcctaaccttgtgattcgcctgcctcagcctcccaaagtgctgggattacaggcgtgagccaccgcgcccagctgcaacagaaatttctaaaaattgctgaaagtagattttaagtgttcttaccacaaaaaggatatgtatgtgaggtaatgcagacgttaattagcttgatttagccattccacaatgtacacatatttcaaaacattatgttgtataccatacatatatacaattttatttgtcagtttaaaaaagaattgaaagaagctatctttgatctctatgtgccaggtgtgtttccaaacattaatgaacgcatttaattctcacaagtattatcatcagcttcactttacagatgaagaagcaaagtcacagagaatttaagtatcttgctcaagtcacaaagttaataactggtaaattgcaacccaggcagtgtgtctgtagggcacatggtccaactactccactcctctgccagtctataggcttcttggggcaagagactgattttggtgatggtgtagccctaactccagaaagggtcgctgtcggaaaagtgttggttatatgaatgaacaatacactgacactctaaacagtttggtgtgtgccaagatagagaattcaaaaaatgctctatgagatgaggatataggaatagcttagctgtgaaagaagacagaagcagtctgtaatgggaggagagtttgaatcaaggaagggtataaacgtgtagttcttataaggatagttgcttacggttcctatgttcacatcttccttatgctcttgagaggaactggacttaatgcacttttctctctttatcttttcccaaatttgagtgtcgtgggaagggctctgtttgactcagtgtgagttaggtggcttttccttggactaatcagtggtggccatgggtacaggctgcttggattagcccagcttggcttccacctttggtggctgggggtgggagtgaggattctgcaagttagcagctctattttgaactgcctggttaaaaggagtatgtccccaaataagttaatttttacacagggatctacatctgtttattttttcccccaaatggatagccagtagttcttacaccacctcctgaaaaattcacttttgccccatagatttgaaataccatatttatagtacattaaattcctagatatactcagatctacttttgaactcttgatttttatagttttgtgctagaatgtgctgctttagggagattcaccctgcagcctttggtttgtaccttgtgatttaccagccttcttttcctatccttcaatccatcacataccttgagaagccttatacacaaggatgtggacaccttagcccacatgtctacagtccaggcaaacagtgatcttttggccacccattgggcctagagttgtgtacacaggtgggatatctgcttctgggaagataatccttgagataggcccatgcagatcttaaaagtgtgtttggggatgtttgtgcagggaattctgaaatcctagtacccagaatatggtcaagaagaggtatttagactctaaagggctatgtctcctttgtcctgtgattttctcacagggaaagggataagaatagctgaataatagctggggtggaggcacagaactctgagcagggacgtcacttgctcaggtctaagggtggcagtgttctgtaccattactgccagaatacatttgtattcatgaaaccatggtatctgttttagatttaagtatacagttgccataactctaggtaagctctcagccaccatcactgttttcactccaaaggaagttcatgtccacagggatatttttatcacattacaccattgacctggctgtgtggcctgtttctgcctttgatacttataaatacaatttatgcaagtcctgcaaaggaaagaagtctttctatacaattatgatgtatttattcatttagctattcacttattcactcaatgattatttgtggagttttgactatgtgcttggcattgttatcatccctgcagatgcagtggtgaacaaatctttccctccagtcattccccaggctgcacacgtgttcatatcacttccctacccaaacagaactacttcttagtcaaagagatacaactctcaagatgatttccttctcaggaaaattctccaaggttaagctaagccttagatattaatcttttgtcatgtggtagtgattggtggtggtggtgatgggaggggagttatgtagggaaatgagaatctatattttcccccttttttaaggtggctcagagggaacaactatgtctttttagaagttctgttttgacttaaagaaaagttagtctagcattcctttttcctgtttgttgggaaatactccttataaacagataaacttcaggaaaaatgagaaattctggaaaacttatcttcataaggtttatttttctccccccttttatatcacttcaagaactttgtggaaagagaactgaattaagaattagggagcataggttgtttctgattcttcctctaagtaactatgtgacattggacatgccatttctactctatgtgcctcatctcttaattaatgaaattgagataactggaaggattgttgtgaggattgctttatgtgtgacatatgtcttggaccccaaataagagtgggtatttaggtgggcagagcaatcagatacctaagacaccaacactgtggagcccttataactgccctgaactgctgacatttgaactgtatcatgataaattactttattttggcctttgttacatcagttggccctgtattctaatttaatcttcgatacctgaaaactgctttcagaaaaggagctaatattatctgtgtacattgtagttaagttgcgtttaagcaccaacttaaaaaagctatttgtggaatcacagcttttgtccttgaaatacacttttaagcattttagagaaagtaaaggtagggaaacacgttttggggaagaaaagttgtcctggttttgctgagaacactatgtagacagtcatcttctcatccatgtgagaatctgtctctgcctggatacaagggagacacctctccctgcagtcttcccatgctacattcagtcctccctcctctcatctttccctgattgtgtagtgagtttcactgggttctctgaaagaatctttgaattccattctaattctcaaaaattgtgcttctgtgatatgcaagagttggtggggttccaccatgaattccaggagaggccataggtaagctgtggtcacttgctgtcatcagcactgcagggatcccacacatatcctgcaaaatgcctccttctgcagtataagtaatgaacaagtattaagtaaagtgatatttcatttaactattaaattagcaattgtaaactgtataaacaatattgacaaagagtaaatgggtactgaagtgtactattgatggcataaactcatatgatgcttttgggaggcaatctggcaatcttcactgtgtctcttttctcactttttacttgctcttttacccactgaagtgtggttttaacttccaccattggcccaaactattcttgccagggttaacaacagtttcttgggttacatccaatgaatgattgattattccctctttgaaacctggtcctctttcggtttctggtataccactttccctttaaaaaaaaaatttgagagctgattttcaatagatcacagtgagggagctgctctgctatgtgtgaaaccccagcctacctctttctttttgatgttcttatatctttggctgaacctgcactgtcttttttcatgggcttttcttctgctcactcttttatcgggaacctgccctgatattcacgtaggttcctttctatttttcccaagcgtcagccggcttgagaaataaagggacagaatacaaaagagagaaattttaaaactgggtgtctgggggagacatcacgtgtcagtaggttccgtgatgccccacaagccacagaaaccaggaagtttttattagggagtttcaaaaggggagggagtgtgcgaataggtgtgggtcacagacatcaagtactttacaaggtaatagaatatcacaaggcaagtggaggcagggtgagatcacaggaccacaggaccgaggtgaaattaaaattgctgatgaagtttcgggcaccattgtcattgataacatcttatcaggagacagggttttgagatcaaccggtctgaccaaaatttattaggcgggaatttcctcttcctaataagcctgggagcgctatgggagactggagtctatttcacctctgcagtctcgaccataaaagacaggtgcacttagggggctgtttataagcctatacctccaggcgcgtattctctttctcagggatgttccatgctgagaaaaagaattcagtgatatttctcccatttgcttttgaaagaagagaaatatggctcagttccccccggctcaccgcggtcagtttaaggttatctctcttattccctgaacaattgctgttatcctgttcttttttcaaggtgcccacatttcatattgctcaaacacacatgctgtacaatttgtgcagttaatgcaatacttacagggtcctgaggtgacatacatcctcctcagctgacaggattaagagattaaagtaaagacaggcataggaaagcacaggggtattgattggggaagtgataagcgtccatgaaatctttacaatttatgtttagagattgcagtaaagacaggcataagaaattatacaagtattaatttggggaatgagtaaatgtccatgaaatcttcacaatccacattcttctgccatggcttcagccagtccctccgtttggggtccctgacttcccgcaacactctttaaagttggtgttcttttttttttttttttttttttgagacagtctcgctcttgtcgcccaggctggagtgcagtggtgcgatctcggctcactgcaacctctgcctcccaggttcaagcgattttccttcctcagcctcctgagtagctgggattacgggtgcctgccaccaccacacccagctaatttttgtacttttagtagagatggggtttcgccatgttggccaggctggtctcgaactcctggcctcaggggtccgccagttggtgttctttaggattcttcccttgacctatttattttctcagtcaaaaattctttctgggtaatattatccatgctcatgcttccactattatttgctgattattttcagctcatatatctcttctgagcttcagtttaatatatcaaactgggtttttgacctgtgtgaattttccagaagcaccttaaatcaaatggtgcaaagcttagctctttatctttcttcctttctcccccacttcaccatatgaaacaaaacaaaacaagataaatttgctccttcttttgtgtttttcatatcaaacaacaggaccatcatctacccaagtgccatccactctcttgctccaagcctgtccagatgctgtgccttctgcctctttctattcagctcagtcttcatcatgctcattcttcctcttctcttaggttttagtttaggtgagtgtcactccttctgggaagtcttcctgcagtcctacaaccaaaaccatttcacttccttgtgttgctatagtactctatgctttccctactatggctgttatcatgaggactatcattgcttttaaaatcctcttccttctcactagaccactgggtctttcttgtcattgaatggccagtgtctacctcagtgcctgactgtaaaaggggctccacaaatatttgtttattgaataaatggatacttcccaagactcttaaaatgttcttacacgaatccaggaaatcctctttgcagaagctagtctaaataaataattggaagtttagacaaagatttatgtacaaaggtttttatgatagtattctttctaaaatccaaatgtctaatactaaagaaattggtaaataagttatagcacatttgtaccatggactatgttgaggctattaaaattggatttttatgtatacttgttgacaaaaaaaaagtttggaaaagaatattaagttgaaaaaacctccagcatgtgcaaatgtgtgtgtgttcatgtgcacacaattcaattgtgctaacaatagtcatgcaaaaacaaaggattaaaaagcggtatgcctcaatattatcaatgatttttttctgggatatggtattacacgtgattttaaaacactttcctatattttccaaattctgtatttagaattcattattcttctaaccagaaaaaaaatcccacttaaaaagaatttaaaatatccctcttgtagttggctattgctatagggcgtggttttcttccataaccttaggaactttctaaaatttgctttaacaatggtctaaattttttattacaatatacataaaaaacaacattaatgtatgtgatatgctcctatgtgttcacccaaacacttttgaacaccaaaaaatgttttgcaaaggagtatatatatattagttaaggttctccagagaagcagaactaataggatgtctatctatctatctatcatctatctatctatctatctatctatctatctatctatctatctatacataaatatttattggaatatgtatatttattggaatatacgtgtaattattggttatatataaatcttggtccaagtctaaaggctcaagaatcagaagcactgatgttagagggcagggaagatggatgtcccagctcaaggagagagagaaaagttgtccttcctctgcctttttgttctattcaggccctcagtgaatcggatgatgcccacctgcattgattagggtagtctttactcagtctaccagttgaaacgtgaatcttttctgaaaacaccctcacagacacaccccacaataacattttaccagccacctgggtatcctttagcctagccaggttgacacataaagtcaaccatcacaacctacttaacatataatatataatataattattagcaccatatattagtttgctaaggccgtggtaacaagaggccacaaactgggtggcttaagcaacagaaatgtattgtttcacagttctggaggacaggagttcaaaatcaaggtgttggcatggttgtttccttctgagggctgtgatggaaggacctgttctacgcctctgttcttggcttgtagatggccatcttctccctgtacctcttcaaatttttcttctgtttttgtccatttcggtgtccatattccccctttttgtaaggacaccagtcatcgttcaccagtttggattcgagcccacccaaataccacattttaacttgatttcctgtaaaaactgtttccaaataaggtcaccttctgaagtactagggatttgaactccaatatgcatatatattttttgggtgggaggaaaacacaattcaacccacaacacaccactaccatcagtaattactttcattccataggctgagggatagaaaaacttccagtgtttctacctccagttgcctggtatccagtaatattctccaaagtgaggtaacaggtggcaacacggaaacttcaagttccgttttttggcctgaaaaaggaagaccattttggcttggtgatatttcctgcattaaacatagtttgtatttctttttttttttttgagacaaagtctggctctgttaaccagcctggagtgcagtggcgccatctcagctcactgcaacctccgcctctcgggttcaagcggttctcctgcctcagcctcccgagtagctgggactacaggcgcgtgccaccaccacgaccagctaattttgtatttttagtagagacggggtttcaccgtgttagccaggatggtctcgatctcctgatctcgtgatctgcccgcctcggcctcccaaagtgccgggattacaggcgtgagccacagcgcccggcccatagtttgtatttttatagaacactctcgtttagaaataacttacttatgttcatttaatccttataatctctgttgccgagatgaagaaattgtgcctctcaaatggtgatttgaacaaaatctcacagctatcaaatccaaaggattgtttcaattcagtgtgtctaacttatcactcagtgttttcttccataactgaaaatagacttcatagtccaaaccaagctctctgctattgcgtttacaaagaaatgtgacgttccataaattgtgccgatctgagacctactgacttgtgtgaaacattttttctgagtatagttaccacaagaggtcgctgttgcaacgagttgcgtttaaagggtaacccatttattttcatttctgtacaaggtgttctagtatcttcaggtccctcataaaaacatctttgctccttcacttgttactgaggaaagcctggttatttatttcatgacctgtgatagctcctctgtcaaaatgttactagaagccatcaacactcactgatttttttttgcatgggaaaatggaaaaattgctgattcagaatgctttcggcaattctagacctagaagaggcacctcccaaatattttccagtgatttttttcattcctatattataagagaaaagaactcaaacaacataccactatcttttccatattaatgtgagtatgtaacaggttttgtttctagcatttggctgattcaatgagtactactgtgtcttttggattcaatgaatactactgtgtctttcggctcttttcctgaatggctttatttttcttttcagtttttgtgcttctgttataggatttatactaattatttcctgaaggaagtgtgtacagtaactacaaaaaattagatatataatcctacacgactgccttctactagccatggtactctgcgctctgaatcagatgagaagaaagggaaaggaactataatttactgttgactacgtgccacagattgaaaccctgaaatacatattattgttcccattttacagatgaagaaaccaagactcagaggagtgagctgcctgaggtcacaaggtggcagagttgagatttagatttagatctgtctgacacagcctgtgccttttcttcttgttcaccttacctcctccttggttaagtgagtgattccagaccaaatgtcctatcctagctggtcagcagggactaatgagaggtttgttcctctgtttaatatctgttacacagggtctgagaagaaggtattagttgtggacttagtgggattataaatgatcccagggaatcaggagatggaatgtccagtccagactgcctcatttgctctttcttggaataggattaggaatccctgtttcttcttggctaaataggggtcagtggagcactgcagggcataaagtaacaagtcaggcaggttacacttagaccatgactgtcaatgagtccatgagtgtcagaccgactacagtacatgaccaccctctcgggctgtggaaagtaatgtaatggggaataggagcccaatgtaatctaccttctcatagctttgcctcatttggaccaaatctttaagggattagacctctgcaaagatctaaaatgaaattcaggctgctgtgcttcagtaccagcagttttcactccctactcttcttggggctttagctgaactttgaggggagccctgctctgaggagctgctgccctgctattggctgctgtactggggcagcctgagtgacagctgctggtgtgggccctggcagttgctgctgggctcattgcagctcagacacagcaaaagagcctagaacctgggtcctagtttgcacctagaatatgaggcaagtggcgagagtgatcgtgttcctgaccctgagtgagttattttgggatgaagaggaatgggatctgggcctgatgatgctggaaaggaatctggaactttgcctgctagcagttgctctttatccaagatgtagagggatagcttcagggttccatttttctccaggcagctcctgagcatttatgtgagatgtgtctcagggcagcaaagattttcggggtttctaatccctagggtctatccatgggagggagatagtaaacctgacacttctgtgtatgcctgggataaatatttttgtactgaaacataaatgagaagtaaattgtatgtacatgtatatggcagggaagtagagcgtggggatggatttgactgtgagagggaaccgtggggctactgagtgggaccgtctaacttaccttgctttcaggataggggctaggattgtgttttactcccataggtactttgagccttgctaagaccacccagcccatctccatggactcatatgaaggacaagaagtgaacataacctgtagccacaacaacattgctacaaatgattatatcacgtggtaccaacagtttcccagccaaggaccacgatttattattcaaggatacaagacaaaagttacaaacgaagtggcctccctgtttatccctgccgacagaaagtccagcactctgagcctgccccgggtttccctgagcgacactgctgtgtactactgcctcgtgggtgacacacagtgagacagatgggcctgcacctgtgccgttttcctctgtggggtgggagtcacagcctagaaagaagtccaaaagtgctttctaaaatttttattttcaaaaggtattagcaaatttatgtattcttctactatttgcaaaatcaatcttatttattttttaaataggtatttcacttatgtgatctaaaattaaaaaagtataaaagggcatacagcatgatgtcttccttccaccatggtccctgagtactcaattatcaaagtgaggtatctgtggtatttatactattgttgctaagttcactggtactcctcagtttgtgtgtatagatagacacacactacatatactttatatgcataccacgcacagtcaacatgggcaatatgcttcttagcttttgaaacatttagcctaagtatcaggttattatttatagctgcacacattttgaacatttctgtggccatttccaagtatctacatgctggtttccatgcgtcccctgagattagatctctcactctctctgttgcctgtctttctcttttcttttgtcccacttccctattgtggatggtatgtaatggaaaatggaggtgatggtagaggaggagatgggagagaatttgtttctgatttgcattgtagactatttttgaaacatttaaatcagaaatggattctggatcattattagtttttaaagttgggttctttgaggctccaaagagagaagaataacagaaaatttgctgaaaatcctgcttgggctcctgaggcttcattaggatcatggggtatgtttttgtttgtttgttttttgtgggatgttgtctctgattttgatcacaaggaaagcaatatttgataatttttttattgagaatgagaggatcaggctatgtggcaggaggaggtttccatctagttcatctgagggtttggtgggggagtagtattgtggaaagaaaacaaacatttgtagagtattcgagcctatacactcatctcctttgtctgacttctctacacagtgacgaggagctggcagaaagtgggagtcctggtccccaaatgtccaggatgcagccaactcttctctgaagtgctccactatttccagtacttcatgtggcacagacaatatcctcaaaaaagcctagggtttctgattttcatattctcaatggagaaaatgaggaaggaatatttacagttcatttgaataaagacaatgaatacacccctttgcacaaaacagacccaaaggctggcgactctgacacctacatctttgtgagaagctcagagtgattccaaagtccctggagagcctctgcccaaagccgcactccagtcataagagttgagagagtgggatagagggacatctctgtaatgttcctgcctacttatgaaaatcaatacccacgtatgagaggctgtgtgggattatctaaagaagatactatactattctgtagataattgatctggaaaaggtggaatattggattggaaaatttcaaaatgttttctacccacttggagttcatcccatgcctgctcttgggatcttggttggatgatgcctttggggtagtccagaggaaaagagctgtgctgtggagatggggagccgggttacggtccaggttgtttcaaggaggaactgactgtgaggaaacaacacaactagcttttgtttcaaggtctgcttttatgaacaggtatctgtatgttagccattttggaagaaagagttgaacagccactgagggatggtagaaggggcactctaattctagttgtactttatttttactacatgctctgggcagcaaaacagactggaaaaataatcagctctaaagccaggcattcctgggtttgaatctgagatctcctgctgtaaagagtttgaccttagtcaaatacttttggcatttgagctttaatactttgtctataaaatgagggtcataatactatttttccagggttcttctgtggttaaaagactatcactaagaatgtcctggtttaatcagcactcatcagattaatgctatctatatcctgcattatcattgctattaaacctcacctgccaacccaaaaagctgtttggaggatgacatcacatactgggtgttcagactcttcagaaactgaaaaagacctgagccaatacaagaacatttttttgggagttaaaactcttggtctgtgacaaaaagatcaataaattgatcaataaattgatctgctatttctctgtagaaagatcacatgatttttttaaacaaaatgatgtcccctcagaaggggagatgttgggaggggaaagggagatgcaaaattacttgttgggtacaatgtacactacttgggtgatgggtgcactaaaatccttgaactcaccactatagaattcatctatgtaaccaaaaaccacgtttacccctaaagctgtgaaatagaaaaaaattttaaaaatgaggccagggtcataccattatttttttctctgagagagaaacagccaaaattatttcatttggaactcattagtacatttactcagcaaatgtttattttgtattatgatgtgataggcaatgatgtaatggaggaagtaccttattctccaatatagataagttttctgcacaaacggaggttttattcttctgtgggcagacaacacaaacaaagaaaaaaatgatttccaaatataagtgacatttggaaaacaaaatagggtaatgtgaaggagaatcatggtggttatggaggtcatttagtggtgacatttgagctgaatcttgaatgacagaaaaatgacaaaaccatttaagacctggggtaagaaagagttttcaaatgcaacaatggtccttaggcagagcatgtttgctgcatttatgacagaagctggtgttccctgaatatagtgagaaggagagtggtaggaaataatgtcaaaaaggtagttatggacttgaaaatacaaagccttgtaaatcatggttagattcagattttattctacatgtattgggaagtatttgactacctaatttatattttagaaggatcactcttcgtgctctggggaatggctcatagggttggcatggggagagactagggcacaaagacagttagaatttgcaggggacccagtgagacctgatggaggtatagactaggtggtagaagtgggaatgaagaaacatggatgaattaacttatattttggaggtaaaaaatagatcttaatgatgatttgtatatggcagatggggaaaaaaagagagtcgatgatgacttttaagtttttggcttatgtagttacatggaagatgagatagggaattctgagagaggaaatatttttgattatagtaggcaggtaaaagtgtcatttcagatatgttaagttagagatgtctataaggcattcaactgtagttgttgaccagggagttccatattgagcctggagctaacagaggacatagctggcctatgggatagtgttcaagccacgcattgaatgagatcacttagggaaagagtgtggatggagaagaggttcttaacctgagcacttggactgtcagttgaggtttaatagcgaaggaaaaatcagcaaaggagatcgaagtctattagtgaattggaagggaagccaatagaatgtgctgtcacagaaggcaaaacaagaaaatgtttcaaggagtggtcaattgtgtctactatactacttctgggtttgggtgggagcttatagtgtgaaaagaagaattagtcagaagagacagatggaaaataacttcaactggaaaggattaatgatataatccattagtgttcttattcctgcatttaaaattttcatgaaattttatatattgactttttttcttaatggcttctggcgttggtatcacttaaaaaggcctttgttgccttgctattataaataaccttcaatttatatttcttctataattatgttagtagctttgttttcatacatggaaactttgtggacaatcataaacttatttttagaatatggagtggagcagcgacccagttttatttttccccaatatttattgagcgacgcatcctgtcttcactaatctgaaattgcgtatttctctaagaatttgggtctctgtcttgcctctatctgtcctctcattgctatttgtgcacatattccatactcatttaattacttgacaaattatttgataaattatttcagtagtattggacccagtttatgtactttcctgctttaatttggccattgttttctgctcagtgttaccgctaatcctccgggaaaactgcctagtacaaactgcattctctaatctggagagagaaagttaaacttctgtaggaaaaagttgcctcaagtcatagttgcgtttgctgaggggcagggaccactgaagtggctctcctgatctctcatgttacttgcaggcaaaggagaatttaccatgaaactcctcatttcagaggcattttccaaaatttctttagtgggaggtcctgtaatgctgcagttcccaacctttttcgcaccagggactagtttcatgggagacaatttttccacagaccaagggagtgaggatgatttcgggatgaaaccattagctcatcaggaattagttaggttctcataagaactaggcaacctagatccctctcatgcacagttcaccgtagggtttgcgcttctatgagaatctaatgccattgctgctctgacaggaggcagagctcaggtaggttttatgatcagaaaaatattaaacaaaatttaacagccttggaaaagttatttataaacattgcattttatttaagaggttgaatatatacattgttttgccattttgaatttattagcagtgtggcaaagttagcttaatttgctattagtaaaactgaaaaccatttgataagctcttagaattatgctaatttgtctgaacggtagtagaagctattttaattaaaaactgtagctatatagtttaatctatatagtttaaccctcataatttgatagaattgagatcataggtgttgtgaagtatgactaatgccctaatataaataaacaagtaataaactgtcataaacagtctcaatatactctgaattctttcttccaacagatttaatttgtatagacaatagtaatacattcggataaaaattccaaatttgatttcacttatacttgttgatgtttgtaatgagagagtctttctgcgtatgttaaaattcatatgttaataggtgttttaaggagcttgtaaaaagagatgactatggaaacacataattaccctaaattttcatctttcatttgaaaacaaatttctcttaaatttaggatttttaaacaacctattatctgtctttgatcaaatggaaatttaatatatgtaaataggcaccgatgtttgcaagtaaacggcataaagagtggtaaagtaagttatgtgagggatgttttttaagtaacaagaagaaaaaatgttatgatttgtcggtaatatgtataaaataacactgtgaatatttgggaaatacacaaatgagaaaaaaatttaaaaatgctgtttgaaggttccaaacagtgacaaaatataagaatatactgcgggagatatgtcacttggacagaaacacactgagtgaagtccctgtatggtgtatggcacatggaaatgaagctcaagcagaaagcagctgtcttattggatttaggagtcagagtttggagttcggtgctgacagagtagctgaaattcaaggggggatccaggaaaagaaggattcacagtgtgaggagttacaaaatcttacaaagccacacttagttaggaactcggcaaaaataacaaaaaacaaataacccggctgggtgcagtggctcatgcctgcaatcccagcacttcgggagaaccaggcaggtggattggttgagcccaggagttcgagaccagtctgggcaacatggtaacaccctgcctctactaaacatacaaaaattagccaggcatggtggtgtgtgcctgtattcccagctactcaggaggctgaggcagaaagtacaactgagcctgggaggtccaggctgcagtgagccatgatggtgccattgcatttcagcctggtgatataagaaaccctgtctccaaaaaaaaaaaaaaacaaaaaccaaatatatatatatataaaatttattcacattatatatattttatatataaataaattattcatgtcctttactcactttttaaaccccataaaaaaagtgagtaaaggacatgaataattgtttaaaagaagacatagaaatggcaacaagcatatgaaaaaaggcacagcatcaataatcgttagagaaatgcaaattaaaagtaatgagataccatcttacaccagtcagaatggctattattaaaaagtcaaaaaaataacagacattggcaaggatgcagagaaaagggaatgcttatataatgttggtgggaatgtaaattaggatgacctctgtggaaaacagtatggagatatctcaaagcaataagaatatagctactatttgatccagcaatctcactactgagtgttattcaaagaaaaggaaatcatatcaaaaagatacatacattcatatgtttatcacagaagtattcacaatagcaaagatatggaatcaacctaattgtgggataaagaaaatatagtatatagacacaatggaatactattcagccatacaaagaatgaaatcatgtcttttgcagcaacatagatagaactggaagccattatcttaagtgaaacaactcagaaacagaaaatactgtatgttcttacttataagtgggaactaaataacgtttacacatggacacagagagtgcataatagacactggagagtctgaagggtgggagagtgggaggggggtaagagatgagaaattacttaataggtacaatgtacattattcaggtgatggctatactaaaagcctagactttatattcatgtataagaaatgcacttgtagctcctaaatttatacaagttaaaaaaaataaaactatcccttggttgattcttgagctgtgcaggcataagacaagactctaagaaagtaagtagaaaacagcagccagatggctgagagaaaagattttagcagttaccctcaactagggcaatagaattttaaatgcaagtgctgccaagtgaaagaggttgggtaaaaacttaggctttctaatgaaaacccagaaggaccacgccctaaaaataagaacaatactctgggactaaagggtataccctacaaataggtctataccctagaacaaggacatttaacaataaattaatgctgtgagtgtatgttatcagcagagtcatacttcaaaaattataaagtatttttgttaggtggtttgttgactgaagggaaatgatatcagatggaatttatgacccaaggaagtaataaagaacattaaaaatagtaactatgtggaaacattaaaaagagattacttttctaagtttttcaaaatacagttgacaaatgcaaaaataataacaatgtattacaccgttaataacatatataaataaaatcaacagcaataacacaaaaaactgaaggggcataggattaaactgttgtaagattcttgcattatgtatgaagctgtataatattaattcaagagagaatctgatgaactgaggatgcatatgataatctgtagataaacaattaaaaaaccaaagcaaaaaggtttagctaatagccaatgggggaaatagaatgaacgagtatagaaacttctcaaataaatcaaaagaagggagaataaagggcatattaacaaagactagaggaaaaacatagaaaatggattatcattgtagattcaaaccaaataaaaataattacattaaatgtaaatagcataaacattccaaataaaagggagattttctcaaactagacaaaaagacacaattgtatgtcattcacaaaaaatgtactttaaagacaaagatgagttgaaagtaagaggcaacctatgccatgcaaatagcaaccataagaaagctatgtgtctttattaatattaaataatatttgaaaatgaggggtgttatgagataaaagcgttatttaataataaacagagggtcacttgatcaagaagagataatattctctaaatgtttatgtactgatagtagagttataaaatatatgaaaccaaattaacagaattaaaggagaaataggcaaatctgtaatcagagttggagactgtaaggctcctctctagtaattgatagaacaagaagacagaaagtcagtaaaaatatacaaggctggaacaatcaactagatctaattgacatttatagagcactatacccaccaagtgcactatatacattcttttcaagtacacacagaacgttcatcaaacagaccatatttttagatgtaaaacagtctcaatagatttgaaaggattagaatcctacagttttctcaccacaatataattaatttagaagtcagtaacaaggtatacagtagaaaatccccaaatatttgcaaattaagcaatatacttctaagtcacccattgagaaaagaagaaattgcaaggaaagttagaagatattttgaagtaaaaaatgataaaatatagcccgggcgcggtggctcatgcttgtaatcctggcactttgggaggctgagttgggcggatcacctgaggttgggagtttgagaccagcctgaccaacatggagaaaccccgtttctactaaaaatgcaaaattagccgggtgtggtggcacatgcctgtaatcccaactactcgggaggctgaggcaggagaatcgcttgaatctgggaggtgaaggttgcaggtgagccgagattgtaccattgcactccagcctgggcaacaagagtgaaactgtctcaaaaacaaacaaccaatcaaaacaaacaaaaaaccccttaaaatttcacagaaaaattctaggctcaggtagcttcaaaggtgagttgaatagaacatttaatgaagaattaattctaacccaacacaaaacagaaaatagaaggagggcagtccggccccatctgtagtcatccacattgaatcatcagcatcagcatcaccttggaatttgttagaaatgcagagtcttaggccaaactccagttctggtgattcaggattctcattgtagcacagttcctgaatttgtacattttgttaagcaatgtggtcctgaagtgaggaagtaaacagaatgatgaagggaggtgggaaaaatatttttttcaagttctagtttttttttaaaaactagttaattgttttattttgttgagactctaaacttaccttagattcaatttttttaaatttgtgagtgagattgggctagaacagtggttcccctgtgggagcaattttatccttcaggggatattttggaatatctggagatattttttattgtcgtacagagagttgaaactggcatttagtggagagaggtcagagatgctctaaacatcctaaaatggacaggagagcttccaaccaagaattattttgtacaaatgttagtgctaatattgacaaactgtggactacagaatcctaagggtcctaatagctctgaaactctgggatccaatttaactgaaaaaacattcactgaatactgtgtgccaagttattatggtcttacattggtgtgccagcggggagacactgtcccatagcatgggcatacactatctggcccctaaccatgtataagaccattgatctatgccaaccagacaatacatgttcagaattttgaaaagaataggaaagctagggtcagccactctcatactacaaggaaatcagtaattcactctctgacataagtaagagtaggccaaggactgtttataactaacctcatcactcaggtgtactttctatttcatattattaataacaaattatactcattatcctgtatttataaatataatgtgcatcacatacagagtgaaagaaaaaatgaccaagggaaagaaaaagtagataaattgggagcaaaatgaacattgcttatgcatattgaaatccatgtcagtactagaaaataaagctattccatgccattgtttttgacaataaggcaacattttatgaaaaaatcataggggtagaaatttttccagaccataattgtgagtagagttatagtaaataggtggaacagaagcagaccacctaacgactagtattttcaactctgcatgctatatatccgaaggacagatattgacctaaactgttaagaaaagttcaaggaaaatgcaactaagaaatatgataaaggatctgggaattatatgatatgatgaatgagtaaaaggataaaacaatttaaatgaaaactttaaataaatacatttgatgtatataaatctaaatacattttgtaatatgtacatatctttgtattttaggaaagtgattctgtataatcacacttgagatatattagttatgccatgcagatgaggaattagattaattttctacattgcttggagatctactaagtcaaagcacagggaagggactccaacttgtgaaaaacagtcagaccaagtttccctggacggagagtaaatttgccattgtcagtttcctacatatattatgctactaacaggcattggttttatgcttacttatatttattattacaggaatgaatcagaaagactaaagaaattaaaatagatgatgtagggtttggatagaaaatttaaaatactgaaggactttatcacaggggaatatccaaacaatgattttagcaatagacaataaaatcgagggaaaagtttttgggtctgaaatctgagttagcagtgcccagggtaacaggaggggaaattccactacagatcattcattattcagtgatcacatttgaggacaagccactcattctgacaataggaataagaatacacttggaaaaggtgtacatttgtttacattatctcaatctgtagtctgatgtttcctgagatgtttcctcttttatgtcaatactttgcaataagtaagccacatatccgtaatttcagatgatctgttcttccagaggaaaatatttcagagtgcatgtcagatttttcatcacaatctataggctaaactctttcctttcattagaccaatattattaactcatggaagcctttctccctccttttatcttttattgtataatttagtcattttgaagaaaacaacactcatgttttgacctctggcactgtcaatttcctgggaatggcaagaacaggaacaaggccaggcttggaggagcagagcctgagatagcatgcatctgatatatttagtgaacctgtcttactccaatttttgtgcttaaatgctagcttcagaaagagttttcctctgtgagtgctgaaacaggatggctaatttggctgattgattttctggccaattcaaaaaatagtagagggataaggaggaaacgttttatacctcagtagctttgtagactgaatcatggcattttcttaatttcaagaagactgtcattaataaacacgaaaaacctctaacttcttcaaatatatttaacgtgactcagtagtgtgccgagaagatgcaatggaattctaaaacctacgtttgcactttttctgtctgctaatccacataatttctgactggaggtacacttggaatttactttatttggccttctgctgtttgatgtgccagaatctcccacagatacaggataattggtttagcgtttggggatctggccacaaggtggcagagcttctctgctcatgtagaatgtacgaaaggatccttttggttgacttctgtgagtaggctgacggcagaagcagatgcctctgtggacagtttaagaaaccacagtgctttggaggaaaggaagagatacttgataatatagctctcttggctggagattgcaggtcccagtggggagaacaatgaagacatttgctggattttcgttcctgtttttgtggctgcagctggactgtgagtcgagagcttttggggaacagagggtttagtaaatactcattagaagtctgaggaggagactcatctggtcttttccagaatgtctgaagttactacagtgaaaaaaataaaaaagcaaactccagagaatgatggcctgatgatcttgtctgacttttccttttgcacaggtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagagtacacattgcttctcaggcacctgtatcctgtacccaaacctgcacctgggactaaagccacactctatttcctttacctttaagtcagggattttgctgtaaggtatttttaatgtacggacattacaaaacatcctaaaaggtcagtttcaaaatgacttaatgattttcagaacattttgattaaactctttttgggagttaatgatttcttagttgatatcctggtcttagggttgactttatgggtgccataaagtcatctgaatgatttctcccctaccaaggacatcttggtgtcagagaatcctctccttgatggagtcttttatcttttaacattagtatttattaactttttctaactataaatatattaagtgcacggtataggaaaaaacaggaaattataaaatagaaaatcaaaatgtcttataatcctatcatacacataattcatagctaacatttagtattccttcttcattaaaaaaaaaattaggatcgcttttcctgtggcagcagctggggtgagaagagcagtggctctctcctctctctgccatggcatgtgcttgcccactgatgtcagcgtactctgagaagggagagtcatctggcaaaaatgtcactttgtctgccatattcaaggctcctattcgaccagatattgtgaactttgttcacgccaacttgtgcaaaaacaacagacagccctatgctgtcagtgaatcagcaggtcatcaaaccagtgttgagtcttggagtactggcagagctgcagcttgaattcccagagttcgaagtggtgggactcaccattctggccagggagcttttggaaacatgtgtcgtggaggctgaatgtttgcaccaaccaaaacctggctccattggcatagtagagtgaatacaaccccaaaacgatatgtcatctcttctgccctggctgcctcagccttaccagcactggttatgtctaagggtcatcgtattgaggaagctcctgaacttcctttggtagtcgaagataaagttgaaggctacaagaagaccaaggaggctgttttgcttcttaagaaacttaaagcctggaatgatatcgagaaggtctatgtctctcagcaaatgagatccagcaagagcaaaacgagaaaccatcaccgtatccggcgcaggggcgccgcatcatctgtaatgaggataatggtatcgtcaaggccttcagaaacatccctggaattactatgcttaatataagcaaactgaacattttgaaacttgctcctggtgggcatgtgggacatttctgcatttggactcaaagtgctttctggaagttagatgaattttctggcacttggcataaagctgcttccctcaagagtaactacaatcttcccatgcacaagatgatcaatacagaccttagcagcatcttaaaaagcccagagatccagtgagcccttcgagcaccttgcaagaagattcatcgcagagtcctaaagaacccactgaaaaatctgagaatgatgttgaagctaaacccatacacacagatcatgcgccggaacaccattcttcgctaggccaggaatcacaaactctgggtggataaggcagcagccggcagcagcagcactagaagccagatcagatgagaagggggttgtaggcaagaagcctgtggtatgtaagaaaggaaagaaggccattgttgatgttaagaagcagaagaagcctctggtgggagaaaaggcagcagctaccaagaaaccagcagctgaaaagaagccggcaaaaaagaaatctactacggaggaaaaggagcctgctgcataaactcttaaatttgattattccataaaagtcaaatcattttgaacagcttcttttgaataaagacctaatcaaagaggcagtgaggaaaaaaaattaggatcactcagacttgtattttaatttaatagtatattctaaccttaatgtttcacatttccccaatcttataaaaataaatttttaaatgattttgtgagtgattttataagccagcattttatttccactataatcgtcccatatatctgtggtgaaagacagtatttttctgaactcaggtgttaccctttaaatagtttcttacatgtaggaagttttaaattttctagaaatttattttttcttctgttctagaaataatttgtttcttcaatcacttatgctcttttcctcttgttctttcttcctccttgaagtgctgaatgttttcatttgtcccattttttttctatttttcacagcattttaaagggaaagttatatgtttctaacattgtatgttaaggtttctttcagcactgatgatactgggatttattaaatcttccaggagcagataaggaggtcagggttgatttagaattatttgccaagccagaagtcaggatgtcttttgctagtacgaatggtacatcacttatatttagatgccagttggagaacttgctggagaggtccatagtgatatccacttctgtgcctgaattgcttttatattaccatctctttgtatgattgtatcattctaacagggagagtagtttggtgacctatgttcagtggtttggttccttaaaaatgacaacgatgctatttggtattcctctaatggcatgcaaacaaaccatagtttctttttgtttttgttttttttttttttgagatggagtctcgctctgtcgctcagtggcacaatcttggctcactgcaagctctgactcttgggtttatgccattctcctgcctcagccttctgagtagctgggactacaggcgcccaccatcaggcccggctaattttttctattttttggtagagacggggtttcaccgtgttagccaggatggtcgcgatctcctgacctcatgatccacccgcctcggcctcccaaagtgctgggattacaggcgtgagccaccgcgcctggccgtttgtttctaagattaaaaattttgtttaaaaacagatgtttactttctgaaatgccttatagagatagttggtgtttagtttttcactttgtactcgttatcatcatcatcatcaccatcatcatcaagtggaagctaattcttcctcatataattcatgatcagaattaccctttattattttactctttgatctctttctactccccaggacccctgccactgctttataagtgttagtctaattgctcatttgtccttagagctgtctcaggtgagcttttatcatgtaggcagtaacacatgggttgattggactatccttcaagtctatcttctttataatatgtttaaaaagttgctcagtttttagggctatgacttgtgccactccttgcatctggcacttgtgtgtatttcaccgtttttaatgttttaccaatggacatttaaggaaaggggctaggtaaaatgcactgaatacacagatccatcaatatgtttgaaataatgcatgtgaagcacctagcatgatcctggcatgtactcatcattatttaataccaaatgggtactgacatatcagcagacttcatcctcaatatggatgtagctagataaaaaccaacagaatgtagctttctcttatttctggctcggtgtttcactttttctggtatcatgatgcccactaaattgaacatgtccaaaactagaatatgtcttttaaattttatttatttatttacttatttattttgagatggagttttgctctgttgcccaggctgcagtgtaatggtgtgatcttggctcactgcaacctccgcctcctgggttcaagcgattctccttcctcagtcttctgagtagctgggattgcaggtgcctgccaccatgcctggctaattttgtatttttggtagagacagggtttctccatgttggccaggctggtcttgaactcctgacctcaagtgattcacctgcctcggcttcccaaagtattgggattacagttgtgagccactttgcctggccaatatctgtctttttaaaaataagttttttgatatagacttggcaagatggctgaataggaacagctgtggtctgtagctcctagcaagattgacacagaaggtgggtgatttctgcatttccaactgaggtacctggttcatctcactgggactggtcagacagtgggtgcagcccacagagggcgagccaaagcagggtggggtgttgcctcatctgggaagcagaaggggtcagggaactcctttccttagccaagatagccatgagggactgtgccgtgaggaatggtgcactccagcccagatactgcacttttcccatggtattcacaacccacagacccacaggagatttcctccggtgcctatgccaccagagccctgggtttcaagcacaaaactgggtggctgtttgggcagacactgagctagcttcagaattttttttcatacgctagtggtgcctgaaacgccagcaagacagaaccattcactcccctggaaagggggctgaagccagggagccaagtggtctggcttagcgggtcccaaccccacagagcccagcaagctaagattcactggcttgaaattctcgctgctagcacagcaatctgagttcgacctgggacactcgagcttggtggggagacgggcgtctgccattgctgaggcttgagtaggcggttttacccttacagtgtaaagaaagccactgggaagttcaaacttggcagagcccaccacagcccagaaaggctgctgtggccagactgcctctctagattcctcctctctggcagaccatctctgaaaaaaaaagcagcagccccagtcaggggcttatagataaaacccccatctccctgggacagagcacctggggaaggggtggatgtgggggcagcttcagcagacttaaatgtccctgtctgatagctctgaagagagcagtggatctcccagcacagtgttcgagctctgcaaagggtcaggctgtctcctcaaatgggtccctgaccccgtgtctcctgactgggaaaacctcccagttggggccaacagacacctcatacaggagagctctggctggcatatggcaggtgccctctgggacaaagcttccagaggaaggaacaggcagcaatctttgctgttctgcagcctctgctggtgatacccaggcaaacagggtcaggagtggacctccagcaaactccagcagacccggagcagagaagcctgagtgttagaaggaaaactaatgaacagaagggaatagcatcaacatcaacaaaaaggaagtccacttacagacccctatctgaaggtcaccaacatcaaagaccaaaggtagataaatacacaaagatggggagaaactggcataaaaagtctgaaattcaaaaaaccagaacgcctcttgtcttccaaaggatcccaactccttgccagcaaggcaacaaagctggacaatgagttttacaaattgacagaagtaggcttcaaaaggtgggtaaaaacaaactcctctgagctaaaggggtatgttataacccaatacaaagaagctaagaatgttgaaaacacgttaggtgaattgctaaatagaataaccagtttagagaagaacataaatgacctgatggagatgaaaaacacagaatgagaacttcgtgaagcaaacacaagtatcaatagccaaatcaatcaaggagaagaaaggatatcagagattgaagataaacttaatgaaataaagtgagaagacaaaattagagaaaaaagaatgaaaaggaacaaacaaagcctccaagaaatatgggactatgtgaaaagaccaaatttacgtttgattggaatacctgaaagtgatgggaagaatggaaccaagttggaaaactcttcaggatattatccaggagaacttccacaacctagaaagacaggccaacattcaaattaaggaaatacagagaacaccacaaacatactcctcgagaagagcaaccccaagacacataatcatgagattcaccaaggtcaaaatgaaggaaaaaatgttaagggcagccagagagaaaggtcgggttacccacaaagggaagcccatcagacaaacagcagatctctctgcagaaaccctacaagccagaagagagtggggccaatattcaacattctttttttttttcatcatttcagctttattttatattacatcaaaattatgtttttgaaactttatggagaccataaaacattcgctttcaaaaaattacccttgttgcctatagtgtcttctccataggcatattctacatgtgttttatgatttttttttattttattattattattttttattatgctttaagttttagggcacatgtgcacaacgtgcaggtttgttacatatgtatacatgtgccatgttggtgtgctgcacccattaactcatcatttagcattaggtatatctcctaatgctatccctcccccctccccccaccccacaacagtccccggtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctttttaatgatcaccattctaactggtgtgagatggtatctcattgtggttttgatttgcatttctctgatggccagtgatgatgagcactttttcatgtgtcttttggctgcataaatgtcttcttttgagaagtgtctgttcatatcctttgcccactttttgatggagttgtttgtttttttcttgtaaatttgttggagttcattgtagattctggatattagccctttgtcagatgagtagattgcaaaaattttctcccattctgtaggttgccggttcactctgatggtagtttcttttgctgtacagaagctctttagtttaattagaatcccatttgtcaattttagcttttgttgccattgcttttggtgttttagacatgaagtccttgcccatgcctatggcctgaatggtattgcctaggttttcttctagggtttttatggttttaggtctaacatttaagtctttaatccatcttgaattaatttttgtataaggtgtaaggaagggatccagtttcagctttctacatagctttctacagctagccagttttcccagccccatttattaaacagggaatcctttccccatttcttgtttttgtcaggtttgtcaaagatcagatagttgtagatatgtggcattatttctgagggctctgttctgttccattggtctatatctctgttttggtgccagtactgtgctgttttggttactgtaaccttgtagtatagtttgaagtcaggtagcctgatgcctccagttttgttcttttggcttaggattgacttggcaatgcaggctcttttttggttccatatgaactttaaagtagttttttccaattctgtgaagaaaatcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgcagaggtccttcacatcccttgtaagttggattccgaggtattttattctctttgaagcaattgtgaatgggagttcactcatgatttggctctctgtttgtctgttattggtgtataagaatggttgtgttttttgtacattgattttgtatcctgagactttgctgaagtagcttatcagcttaaggagatcttgggctgagatgatggggttttctaaatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtgtttgcccattcagtatgatattggctgtgggtttgtcatagatagcttttattattttgagatccatcccatcaatacctaatttgttgagagtttttagcgtgaagtgttgttgaattttgtcgaaggccttttctgcatctattgagttaatcatgtggtttttgtcattggttctgtttatatgctggattacgtttattgacttgcatatgttgaaccagccttgcatcccagggatgaagcccacttgatcatggtggataagctttttaatgtgctgctggattcagtttgccagtattttattgaggatttttgcatcgatgttcatcagggatattggtctaaaattctcttttttttgttgtgtctctgccaggctctggtatcaggatgatactagcctcataaaatgagttagggaggattccctctttttctattgattggaatagtttcagaaggaatggtaccagctcctgtttgtacctctggtagaatttggctgtgaatccatctggtcctggacttctttggttggtaggctcttaattattgcctcaatttgagagcctgttattggtctattcagggattcaacttcttcctggtttagtcttgggagggtgtatatgtcgaggaatttatccatttcttctagattttctagtttatttgcgtagaggtgtttatagtattctctgatggtagtttgtatctctgtgggatggaaggtgatatcccctttatccttttttattgcctctatttgattcttctctcttttcttctttattagtcttgctagcggtctatcagttgtgttgatcttttcaaaaaaacagctcctggattcattgactttttgaagggttttttgtgtctctatctccttcagttttgctctgatcttagttatttcttgccttctgctagcttttgaatgtgtttgctcttgcttctctggttcttttaattttgatgttagggtgtcaattttagatctttcctgctttctcttatgggcatttagtgctataaatttccctctacacactgctttaaatgtgtcccagagattctggtatgttgtgtatttgttctcgttggtttcaaagaacatctttatttctgccttcatttcgttatataaccagtagtcattcaggagcaggttgttcagtttccatgtagttgagtggttttgagtgagtttcttaatcctgagttctagtttgattgcactgtggtctgagagacagtttgttataatttctgttcttttacatttactgaggagtgctttacttccaactatgtggtcaattttggaataggtgtggtgtggtgctgagaagaatgtctcctgttgatttggggtggagagttctgtagatgtctattaggtccacttggtgcagagctgagttcaattcctggatatccttgttaactttctgtctcgttgatctgtctaatgttgacagtggggtgttaaagtctcccattattatggtgtgggagtctaagtctctttgtaggtctcaaggacttgctttatgaatctgggtgctcctgtattggctgcatatatttttaggatagttagctcttcctgtggaattgatccctttaccattatgtaatggccttctttgtctcttttgatctttgttggtttaaagtctgttttatcagagtctaggattgcaatccctgcattttcttgttttccatttgcttggtagatcttcctccatctctttattttgagcctatgtgtgtctctgcatgtgagatgggtttcctgagtacagcacactgatgggtcttgactctttatccaatttgctagtctgtgtcttttaattggagcatttagcacatttacatttaaggttaatattgttatgtgtgaatttgatcctgtcattatgatgttagctggttattttgctcgttagttgatgtagcttcttcctagccttgatgatctggcaacagagccagaccctgtctcaaaaaaaaaaaaaagtaaaacagtaataaataaatagatacatatacagaagatacaaggagacaacttgcacgaggaaaagccacatggttcacaaacatatgggaaatgtttaaacctactggtattcacaaaagtgaaagcaaataacttaaaaaacctatcaaggaagaggaccaaataggaacagctctggtctacagctcccagcgagattgatgcagaaggtgggtgatttttgcatttccaactgaggtacctggttcatctcactgggactggttggacagtgggtacagcccatggagagtgagccaaagctggatgaggcatcgcctcacctgggaagtgcaaggggtcatgggagatttccctttcctagccaaggtaagctatgacagactgtacctggagaaatggtacactcctgaccaaatactgctcttttcccacagtcttagcaaccagcagaccaggagataccctcccatgcctggctcagtgggtcccatgaccacagagccttgcttactgctagcatagcagtctgagattgacctgcgatgctgcggcttgatggggggacgggagtctgcccttgctgaggcttgagtagctcacagtgtaaaccaagctgccgggaagcatgaactgggcagagcccaccacagctcagcaaggcctactacctctacagattctacctctaggggcggggcatagtagaacaaaaggcagcagacagcttctgcagacttaaacgtccctgtctgacagctctgaagagagcagtggttctctcagcatggcatttgtgctccaagaatggacatatggcctcttcaagcaggcccctgacctccatgtagcctgactgggaaacccctcacagtaggggctgagagagtcctcaaacaggctaatacccctctgggacgaagcttccagaggaaggatcaggcagcaatatttgttgttctgcagcctctgctggtgatacccaggaaaacaggatctggagtggacctccagcaaactccaaaagacctgaagctgaagggtctgactgttagaaggaaaactaacaaacagaaaggaatagcatcaacatcaacaaaaaggacatccacaccaaaaccccatctgtaggtcaccaacatcaaagaccaaaggtagataaaaccacaaagatggggagaaaccagagcagaaaagctgaaaattctaaaaaacagagcacctcttctcctccaaaggattgtagctcctcgccagcaagggagcaaaactggacagagaatgagtttgactagatgacagaagcaggcttcagaagatctgtaataacaaacttctttgagtgaaaggagcatgtcctagtccatcacaaggaagctaaaaaccttgaaaaaaggtttgatgaatggctaactagaatacacagtgtagagaggaccttaaatgacctgacggagctcaaaaccatggcacaagaacttcatgatgcacgcacaagcttcaatagccaattcaatcaagtggaagaaaggatatcagtgattgaagatcaaattaatgaaataaagcaagaagataaggttagagaaaaaagagtgaaaagaaatgaaaaaaggcttcaaaaaatatggactctgtgaaaagaccaaatatatgtttgactggggtaccggaaagtgacagggagaatggaaccaagttagaaaacactcttcagggtattatccggcagaacttccccaacctagcaaggcaggccaacattcaaagtcaagaaatacagagaacaccacaaagatactcctcgagaagagcaacgccaagacacataattgtcagattcaccaaggttgaaatgaaggaaaaagtgttaagggcagccagagagaaagtctgggttacccaaaaagggaagcccatcaaactaacagtggatctctctgcagaaaccctacaagccagaagagagtgggggccaatattcagcattcttaaagaaaagaattttcaacccagaatctcatatccagccaacctaatcttcataagtgaaggagaaataaaatcctttacagacaagcaaattctgagagattttattaccaccaggcctgccttacaagagctcctgaaggaagcaataaacatggaaaggaacaagcagtacaagccactgcagaaacatactaaatggtacagatcatcgacactatgaagaaactccatcaattaacgggcaaaataaccagctaacatcataatgacaggatcaaattcaaacataacaataataaccttaaatgtaaatgggctaaataccccagttaacagacacagactggcaaattggatagagtcaattccaatcagtgtgctgtattcaggagacccatctcacatgcaaagatgcacataggctcaaaataaaggaatggaggaagatctaccaagaaaatggaaggcaaaaaaaagcaggggttgcaatcctagtctctgataaaacagacttaaaccaacaaagatcaaaagagacaaaggaggccattacataacggtaaagggatccatgcaacaagaagagctaactatcctaaatatatatgcacccaacacaggagcacccagattcataaaacaaattcttagagtctaccaagagacgtagactcccacacagtaatagtgggagactttaacacctcaccgtcaatattagacagatcaatgagacagaaagttaacaaagatatccaggacttgatctcagctctggaccaagtggacctcatagacatctacagaactctacaccccaaatcaacagaatagacattcctctcagcaccacatcacacttattctaaaattgaccacataattggtagtaaaacactcctcagcaaatgtaaaagaacagaaattataacaaactgtctctcagaccacaacgcaatcaaattagaactcaggattaagaaactcactcaaaactgctcaactacaaggaaactgaacaacctgctcctgagtgactactgggtatataacgaaatgaaggcagaaataaagatgttctttgaaaccaacgagaacaaagacacaacataccagaatctctgggacacatttaaagcagtgtgtagagggaaatttatagcactaaatgcccataagagaaaacaggaaagatctaaaattgacaccctaacatcacaactaaaagaactagagaagcaagagcaaacacattcaaaagctagcggaaggcaagaaataactaagatcagagcaaaactgaaggagatagagacacaaaaaacccttgaaaaagtcaatgaatccaggagctggttttttgaaaagaacaacaaaattgatagactgttagcaagactaataaagaagaagagagagagaaatcaaacagacccaataaaaatgataaaggggatgtcaccactgatcccacagaaatacaaactaccatcagagaatactacaaacacctctacgcaaataaattagaaaatctagaagaaatggataaattcctggacacatacaccctcccaagactaaaccaagaagaagttgaatctctgaatagaccaataagaggttctgaaattgaggtaataattaatagcctacaaaccaaaaaaagtccaggaccagatggattcatatccaaattctaccagaggtacaaggtggagctggtaccattccttctgaaactatttcaatcaatagaaaaagagggaatcctccccagctcattttatgaggccagcatcaacctgacaccaaagcctggtagagacataacaaaaaagagaattttaggccaatatccctgatgaacattgtgcaaagatcctcaaaaaaatactggcaaaccaaatccagcagcacatcgaaaagcgtatccaccacgaccaagtcagcttcatcccagggatgcaagactggttcaacatacataaatcaataaacacaatccatcagataaacagaaccaaagacaaaaaccacatgattatctcaatagatgcagaaagggccttcaacaaaattcaacagcccttcatgctaaaaactctcaataactaggtattgatggaatgtacctcaaaataataagagctatttatgacaaacccacagccagtatcacactgaatgggcaaaaactggaagcgtacactttgaaaaccagcagaagacaaggatgccctctattaccactcctattcaacgtagaacactatgttggaagttctggctagggcaatcaggcaagagaaagaaataaaggatattcaaacaggaaaagaggaagtcaaattgtctctgtttgcagatgacatgattgtatatttagaaaaccccatcatctcagcccaaaatctccttaagctgataagctacttcagcaaagtctcaggatacaaaatcaatgttcaaaaatcacaagcactcctatacaccaataatagacaaacagagagtcaaatcatgagtgaacccccattcacaattactacaaagagaataaaatacctaggaatccaacttatgagggatgtgaaggacctcttcaaggagaactacaaaccactgctcaaggaaataaaggaggactcaaacaaatggaaaaacattccatgctcatggataggaaggatcaatatcgtgaaaattgctatactgcccaaagtaatttatagattcagtgctatccccatcaggctactactgacttttttcacagaattggaaaaagctactttaaatttcatatggaaccaaataagggccctcatagccaagacaatcctaagcaaaaagaacaaaactggaggcatcatgctacctgacttcaaactatattacaagcctactaaaacagtagtactaaactacagtttagtaactaaacagttagtacaagtaactaaaacagcatggtactggtaccaaaacagatatatagagcaatggaacacaacagaggcctcagaaataacactatacatctacaaccatctgatcttagacaaacctgagaaaaccaagcaatggggaaaggattccttatttaataaatggcactgggaaaactggctagccacatgtagaaagctgaaactgaatcccttccttacaccagatataaaaattaactcaagatggattaaagacttaaatgtaagacctaacaccaaaaaagccctagaagaaaacctaggcaataccattcaggacatagcatgttgtacgtgttgacataggacaagacttcatgactaaaacaccaaaagcaatggcaacaaaagccaaaattgacaaatgggatctaattaaactaaagagcttctgcacagcaaaagaagctatcatcagagtgaataggcaaactacagaataggagaaaaactttgcaatctatccatctgacaaaggactaatatccagaatctacaaggaacttaaagaagtttacaagaagaaaacaaacaaccccatcaaaaagtgggcaagggatatgaacagacacttctcaaaagaagacgtttatgcagccaacagatgcatgaaaaaatgcacatcatcactggccatcacagcaatgcaaatcaaaaccataatgagataccatctcacgccagttagaatggtgatcattaaaaagtcaggaaacatcagatgctggagaggatgtggaggaataggtacgtttttacactattggtgggagtgtaaattagttcaaccattgtggaagacagtgtggcgattcctcaaggatctaaaactagaaataccatttgacccagcgatcccattactgggtatatacccaaaggattgtaaatcatgctgctataaagacacatgcacacgtatgtttattgcggcactgttcacaatggcaaagatttggaaccaacctaaatgcccatcaatgatagactggattaagaaaatgtggcacatatacaccatggaatactatggagccataaaaaaggatgagttcatgtcctttgcaaggacatggatgaagctggaaaccatcattctcagcaaactaccacaaggacagaaaaccaaacaccgcgtgttctcactcataggtgggagttgaacaacgagaatacgtgaacacagggcagggaacatcagacactggggcctgttgtggggtgggggtctgggggagggatagcattaggagaaatacctaatgtaaatgacgagttgatgggtgcagcaaaccaacatggcacatatatacctatgtaacaaacctgcacgttgtgcacatgtaccctagaacctaaagtataattaaaaaaaggatcaaaagcttttttaaaaaaagaaagaaatacttgtatttgtatgcagtgttaaaaaaaaaacaaaaaaaattaggaaattatagaaatagcaaatcgaaagggagataatttggaaaaaatgcagtgaaacatactgctctggtgggagagtaaacttgtaagccattttaaaaagtaatttaaaaacatgacaataatctaaaaaatattcattttcttcattgtaatgattttctctagagaatctgtcttcaggaaaactctaaatgcatataataattatttacaaaggtatttggaaagttatgtacactaccccaaaatggaaaaccaaaatgtctcatctttaagggaaaggcttaatgacacaaatggaatattatgcaccaaataaatggtgtttacaaagataatctacaatgattattgaatagtaatgattattgaatagtaataattaaaaagaatcaagatatcgttgccacttaataaaaatctgaatagtgcaaatgttgggaaaaacgcactgagatattgataatgcatatctttgcttgataaggtaagtagtgattttctctttcatcctatttttatcagttttccaaaatatgccttagttgattaaaagtctttccaatccaccattttctgtaaattttgtaaaattactcttagctctgaagttcaatgaccctggttcagtcacctatacctcacaatgagaaagcagcaataacctcctgactggttttgcagccactattggattccttttcttatattaatagttcatatttattcagttcttactgtgtctgatgcattatataaagcattttatatacattagccaatgcattctagtgatatcccccattttacagataaggaaattcatacttagagacattaagtagcttgctctagctcactcagagattaaatggaggagtttcaaagccaggtttgtttgaggctggaatacaaactcttaactattctttcatgatgtctatcaacatacttctccaaattattcttgtagataagcagcctaattaatagaatgttaacagaatagaatgtccagtatatggacttccattttcataatattacctcctctaaagcctcaaaagttccttgtttgctaacaaataacctacaaatgaatcctggcattcaaaatcttttgttttctagacctgaattctccttccaacttgattttctgctacattctagcccattctctctttcttctatctgtccatccatctgttcagctgtcattgatctctccatggaatggcataaatgcatctaaggaagtgactacaatacatccatcctggcattaaaaagtagaaaagaaaggatttctgatatatataatcagagggctgctgtattttaaaaataattttaaacaccctctcagagggtattctaggggtaaaaaacccttcactcgtttgaattctcgctgaatttaaactgaatgtctacttattatagcccaacaagataaagaaaaaaggccttttgaagtcaaagcaatacttttttttcacctgtgggaaggcctattccctagatctgggaaagtttcctagaattcagccatacattttctgtgttttacattatctagagcacatgacatctgcaactgtggcaagaaggacagagtagttcaactgggcaatgaaatggagaacttggaaaacttgatcatttgacctgtatccagaattaatattgtcaattccatgttatgtactgagactcaattagcattcttctggacttgttacttacaagtgtggtctgagaaccaactgtatcagcatcaccagtaaacttgttaaaatgtggaatatccagccccacctcagacctaatgaaacagaattcacagcttaacaaaatccccaggtgatttgcatacataattaagttttagaagccctgacctgggagcacgttccattattataacaactttctgaacacaagagggcagtatttcctaccccctcagagcctgtctcagatgtgaaccgaagttcactgcatagctggattaggccagtatgtgtaaggggctgaacaggcttgccattgattggctggataggaaggccagaacttccttctaggggtagaagaaccccagtaacacctatcaaactaaacagaatggctttttggctgagaagcctgggtctacatttcaggccacatttggggagacgaatggagtcattcctgggaggtgttttgctgattttgtggcttcaagtggactgtgagttggagatttcctgttgatggagacagagagatccagggctgcagtgcacaggatgaaggggaggggctaggatccattcttccccatctttggttatatctggggttgtgggaggaaaatagactcaacagtgtcagtgtagtgactaaccctcctacttttggtgttgtgtttctgcctaggggtgaagagccaaaagatagaacagaattccgaggctctgaacattcaggagggtaaaacggccaccctgacctgcaactatacaaactattctccagcatacttacagtggtaccgacaagatccaggaagaggccctgttttcttgctactcatacgtgaaaatgagaaagaaaaaaggaaagaaagactgaaggtcacctttgataccacccttaaacagagtttgtttcatatcacagcctcccagcctgcagactcagctacctacctctgtgctctagacacacagtagtgccctggcagctgcttcctgcacccaaactctgctaactctcacaatcagagctcatggctgtgctgtctcccaaaggctaatcacagctcctgacagaatgggggggtgttagttgaaagggcaattttcaaaacaaacaaacaaatgctctgaagaattcctcagagaaaggagggaggacttgcttttaaaaaatgcataaattctgcttagtttttgtgactagcctagagcagcgtgataaatttatggagttaaacacattacacttaagcattaaaacatggattcttctagatgaaaaaataatccaaacatttttgagtcccttcccaaactgaacactgaataatgatgatgatgatgataatgataaaaaattgacctttttaaaaattgttcatcttatgaatggataaccatgctatattggaaaacatgccataagtcatggcattgcagagataaatttagagccgttgtttactatgtatgtggtatcagtgagtaggtcaatatacaagtcttctttttcatttgtttcttaagagacagggtcacactctgtcacccaggctggaggctggagtgcaatagcacaatcacagctcactgcagaccacaactcctgggcttaagtgatcctcctgcctcagcctcctgagtagctggaattacaagcacacaccaccatgcctgggttgtacaactcttttaagaaagagaacttacaccttctcatgttaggcatgggttctgagttgaggacttctccgttattattgcctgcattgccatttctatcaatttctgtcatctatgtattaccttatttcttgatctatttttagattattgccaaaacagacagatcccataggtcatgcatgttcagttactaacatggcagaatctgtgggttttgactaactctgttttaggctagggctgatatttctgtctgctttgggccacatacagtcactgccaaaatgatatgatcatgaagctgtttgtgtttgagtgtaggaagaggtgcagagagaatatatgtaggataataggggaagaaaacaatacacctagaaaaacagaatttgaggacaagaagtcccttcttttaatcaccattaataaaatagaggcagctaggaataagaaaataatgggctctgagtcactggcatctgggatttgatagtcagagagaaggagagttcaatgcagagattgttaaccatagttggacatcttgaaggttcataaactccctgaaattgagaatagatgaaatattattatgacataattattgtttgggaggagttttcctcccatttctggcaatgaacaagaaaagattcatataatttgaatatggataagagttatgtcagaacagggggctgagagaaggatgagggattgttcaacagctcaggccagagatgaggacagacctaagaaatgattgaatgtaggagaatttagaagggagtaaataattttctccaacaggaattggaatgtctttccctttgtaataaatggagggtataaattacaactggcagtacagcattcaaaagtatgggcgtgggagtgcaacatatcggtggaaaattctgacccagtcaatgactgggctgtgttgtcttggggaagtgtttctagatctctgagtaccaaattcctctcctgtgaaatgctagtaatagaattacctcataggattattgttaatatgtttatacatattaacataaacatatgtatatgtttatacataaaagtataaaaatatatataaggcaactattgtggtggcaggtacaccagtgcactagaaattcaacagacacttgtttatagttcatttctttcaggaagttaaaactcaaattttctgctctaagcattaaatatatctttttcatgttctatttctgtaatctttttactaatcacctcaaaatctatttgaaatgatttggtatgtaaatatataaatgatctgtgtttcacaaaccagagacattaacaaatattattgagtacctgctatgtgccagacactgctatatacagcagggatgcatcaatgaataaaatagacagaagttttggctctcctggagcttatattttattgaaaaaacagagtgaacaaaaaatgtgataagtaatatagtatgttagaagacagtaagtactatgggaaaagtagaccagggtaatggggatgggaaatgtggaggtggagctgtctgcagttggaattttaaatgtggggagggagtcatggtagttcttattgaataagtatgtgaagaaagtgggggaggaagtaatacagttatctaggagagcatgaaccaccttggcaaaattgtgacggtaagagaaatctgacatagctgactccattttgcttctaacctccaagctgtcctgttcattcctgggtgtaggccaagctgactttgggagaaatttagtttatagtttaaccttaaagcaaagatgataatagtccttccccaaacaaccccttccttggttgggggaccaaaactgcctttgtaaaactaacaaattagccgtaagattagaaattatgactcaggagttatgcaggcagaggtcaaaacattagtaacctccccacttgctcctatggatatcaactctatcataggacctaagattggtgttcaaggtatttttcagattctaaatcctgctggaccagctggtgccacctggactggtaaactggctcaactggttttgtgatcccatccaggaactgactcagcacaagaagatatcttcaactccctgtgatgtcatccccaacccaaccaaccagcatttgtcaatcactagccccctgcccaccaaattatccataaaaacccaaatttttgggtctccaaatttttgagtgctgtgggtgggggtctggattcttgattttgggctttgagtctattcctgatgacttttggcttggtaaaaagtcttgatttagagccagctcttttacatggtttaataaaataatccacgcattattattaatgcaaagattaattattaattaataatacatattattaatgcatagattattattagtgtacttctctgtatggaaaagaagtctgatctctttagggtactgttttaactcaaccgtgggtccttcttactggaaagatttctttctttagtacaccataatttattcattgttttcataagcatcattgcagaggaaacagagatttttgttttttaggaaagctgatccaaaatttagagattatgagtttattggaggtctatgattaaaataggattaccatacaaaatattttttaaggcaaaacaatctttcattttatttgtttgcacaggtgacaccattatccacatggaaccacaaggatttatgaaaattctggcatgtcttgccagttgttccaactgaaaactatcctatgcgtggaaatttgcttctacctcagagtctaaaatttaagctaagaatcttgagtatgctgtggtaaaatagaaagaataactacatttaagtaaatatcgagcaactatttgctttccttattttcctcccaactcttctggttttaataagattttctagttatttaaattgaactatttagttgatttaagttgaaccaacccaagaaacaggaaactagttaagtcaccacttgagcaaaagagaaagacgagaattaagttaggttgacaagtgtgagaagaaaaaagagaaaaagttttgttgatctttttaacctcttaaatatctcatatttgtctattttccaccgtcaccaccacctggaggaatgcagtagcctcctaattgttatgtctgtatttactttagcttttgcatttctgatctatttaatacattagcctgccaagatattttaaaaaatgtgaatttaatcctatcatctccctgcttaaaatactcttaagccttcctgttgtgtttatcaaaggccgaaatccttaccaaaacccctccatggtttgctccctacttcttctctagttaatttttactgcaatgcccttttcattcttttatgctcccatcccataggtcagtttttatttccttgaaagtgccagatatcccttaccttggagtcttccaagataccattttccctgcctggaattttccctcattctttccgtgagatcccaattcaattgtcttttggaaaaaccttctttgacacttcacccagttttcaaatagataaaatttctttatgtaagttctcaaaacaccttcctattagctattattagatgagtttgtgttccatgaaagcaggaactatgtttatcgttttcttagcattctattactagaaaactatgacctatggctcatctagacaatggagtcactgtgtctaaaactaatactaagataaagatggtggaaggtcatgaatgttctttttctaaataaagacctgtttttgatctccacccttggacttttccagttttgttttcatagctcttcatattgccaggctgtactactttttgaggagacggtttccatgtcgaattagctcccctgtgaaatgggtttctttccctttattctaacctggtcttcctgaagttctatagggaggctgtgtctaaccatcatgaaatttgatgagcctgtactctgatgattttacaggtccatcctgtgcttctcatgattttacaggttcctgtcccagctggtctatctttttattacagatgtgagtgtcttgatgtagaaatctctcttctctgctgtatgcttcctacccagcaacttttatttttattaactggaatgtgtctcactatgttgctgttttctaaatctgttaggagataagacattctgcttcagttggatgttgtttatcatgtattgtattacaataaaaacgtatgaaactttattatagtatataatgttattctggactacatgcatctatcaataaataattgttaggcatattctgtgctccaggcatcttactacatgctgttaaaatacagctcctgccttgaagcccttactggtcacacatcagaaactcttcttgttcctaaaatgacaaatcaaacaaacaagaataaaacaaacctcttttttgtatttctgtcttcacattgctatgtatttgtttcaaagaatgaaaattggtttctatctgaaactagtaattattaacatttgtttagtactgactacatgtaaagtatggggttaaaatttttacaaaacattgttacttaactttcatagcaatatctgagaagatttctttatcatgatgatgaaactattactggcactatataaaatattcataataagagccactgacttagccagcacaaaagttagatttgaaccgtgtctaccagatgcccaacgccaatatttaagcactatttactgctactagcctagagatctctgttttctgatgatgcagcttggacatgtatcattcctgtattcatttgaggaaaagaaacaaagtggaagctcaatagtaagtaagccaattatttgcagctgcctgtacctcagcacacagaagccagtcaatcagtgaaagtgttctttgatattgagttatataattactgaagagtcctgcttaaacagatgttgctgtgtaggcgctccagccatagcctggattttagtagatcctggagatacctgcaacaatagatcatggagacacctgttatgtacttaataagcatattttccaaattagaaaatggaacatatgatgtgataattgtaagtaaacacaatagacatatgcaggacactatatacagataggtatttcccagcatgtatttgtatttttaacaaacaatgttttgttgctgctgcttggcatcaatataggcaactgggcagatgttggcagtgagggggagaagggtaagtttaccagattcttcttagttggttattagaaatgaatgcactagttagtgtaaacaactttgctttcttatcatgagctgaaaaattttcaccttaggaactgactagagaatgtacaacattcagaagcctgaaggtacgtaactattagttctcaggcagtcttcaaagcccatcataaatagcatttgtcatcaaatcctcccatacattataatgtgctgtagctgaatacagttactggttgaattattgatcttgctaaaaattaaactttacctatttgtatttccaagtgtcattgttactcaaataaggaagagttagtaaaaaaaagttttgacaaatggcactcaaacaatttggtatgcttacatatagaaaaataaaccattatccttatcttacattgtacaccaaaataaagtcaaaatgggtcatagatctaaaggtaaaggaaaagctgtagacctagaagaaaacattggagaagttattcacaacttttgggtaataaaaatttcataggtatgacaccaaaatcataaaccacaatgaggaaaaatcatgtcttggacttcatcaaaattaaaaacttctgctctttcattaataaaatgaaaagacaagctttagactgggagaaatattctcatgctcttgatgcccatatctgacaaaggacttgttttcagatatctaaagaagccctacaccttaataataaaaagaaaaaaagatataagtagtcaaaagatctgaataaacagttcacaaaagaagatatgtaaatggcaaatgagtacatgaaaagatgctcacatcactggttatcagatgaatgcaaatcaaaagcatgagatacactacatactcacccaaatggtgaaaattaaaaaaacctataattctaagtattggctgggatgtggggtaacgaactctcatacttctctgtgatggttgggggacacagcagtgtatttctctgcacttattgaagccactgagagagaaatgatgaagatgggtctaggagaggcatgtctaaccccaggactctgcttgaaatgcccagctgcttctggagccaacaggaaaatcactacacagacaagaagtggctaggggtgtggcaacacagatgtggaggttacagagaaaacattcattgtaagaaaaacacctcctgtctgagcccaaagagcgcatctaccagatgtatcatttaccagaaacatctttacctgtgaatcttgacttgaaggtgagtttaaaatcactatcaattaacaattaaggttaacaattacaacaattggctgtgtcttaattaaactaaactggctaatgaattggctaatgagactcagaaatacgtgtctgaaaataagtaaaatagctgtgaattgttggatgttcaaattcactcattcaacaaatattttgagtgtctaccatgttccagaaattgttctaaatattaatgcatctctttgtttcttaaaaataaatactgtttcacaaataatttggttataggccagtgtgttaagtcacagggctttcccccatggagacctaaatgtctgcatttgtgtcagaacaatactttccaaatgatctagttccctggagtgtgcagatgacttgtgttaatggcttgtgatggtgaccccatctatcagaggtgtttgaaccagagcaactccatcttgaatgggggctgggtaaaatgaggctgagacttactgggctgcattctcagacagttaggcattctaagtcacaggaggtcagcacaagatacaggtcataaagaccttgctgataaaacagtttgaaataaagaagctggccaaaacccaccaaaaccaagatagctaagagagtgacctctggtcatcctcactgctgtgctcccaccgaaccatgacaggttagaaatgccatgacaacatcaggaagttaccctatacggtctaaaaaggggaggcatgaataatccactccttgtttagcatatactcaagaaataaccataaaaatgggccaccagcagtcctcagggctgctctgtctatggagtagccgttcttttatttctttactttcttgataaacttgctttcactttattctatggactcaccctgaattctttcttgtgcaagatccaagaaccctctcttaggggtctggatcgggacccctttctggtagcacatctgcactaaaatccgagtgtgcatcaggttagaatgaggattggaatatgtgggctatgttgtatgcagagtttaaattttactaaagactctcaaactgtgttgttttttttttttttttgcgactgagtctcgctgtgtcgcccaggctggagtgcatgtgcagtggggcgatctcggctcactgcaaactccgcctcccaggttcacgccattctccagcctcaggctccctagtagctgggactacaggggccacaacgcccggctattttattttttattttttagtagagatggggtttcaccgtgttagccaggatggtctcgatttcctgacctcgtgatccacccacctcggcctcccaaagtgctgggatttcaggcgtgacccaccgcccctggcctccaaactggtttttgaagtgttataactttgtgatttgactctcgagagtggtttctgagagtccgtttcaccacttccttgacagccttggtattgtcaaacttaaattttgttcgtcaacctgataagtgtaaatgctttaatttgcatttgattactagtgaagggtatcatctttttatatacttattagtcaaatgagttccttcttttctgaattcgctgctcttctatggagctttcactattctctacatgatttatgggcatttattataggttcttgaaaataatctagtgtaacctgtcttgataaatgtcttccatatatggcttgcttcttcgttttacctatggttattttgtatgcagatagttaaaattttaatgtagtcaaattactagtcttttcttttatagtttagtgtttagtatcaaagataacaatctttcttactatgaggccttaatacagtgttttccaatgttttcttctaattattttaaatttaatttttctcatttgggtatagtaatgttgtttttgaacaaagcttgaggaaaagttatattttatctctccccacaccaataaataatactaggtattcaacagtttaatctttctcccatattggttcttccgtctgtttcccagctaattatcttccactactgaaacaagatcttcctgagaactctacctaataatccgtgaattaggagtttttccagtttgactgctgggaacaggcaggattcttgttcccaagggagcaccaagtgggcagtgctccttgtaatcctcttggatgtttttttccgctggcctcaggtagttgtctcccatgcatgtgctggccagtattctgctgggtactcaagggagaccctacgcagatctctgcagttttttctcggtgcatctcttttccattgggtgccctatgatgtgaattctatctgccttgatctcccagatctgaactctgtttcaactcacagaactgaaaaagaagttaacccgagccccttccccatttattatgaaagacaggaatttttcatagaaacatttcaaagcgaatgttaaattagcattttaaaagttatattttaggcaaatttccagataaacaaactggttaagacacaattttttcacttctaattttgcatcaaaattaggttctcttttcaaaaaaattattttattttattaatttttttgagacagactctcactctgtcacccaggctcgagtgcagtggcaggatttttgctcactgcaacctccacctcctgggttctggtgattcttgtgcctcagcttcccaagtggctgggattacatgcatgtgccaccacgcccagctgatttttgtatttttagtagagatgggtttcatcatgttgcccaggctggtcttgaactcctggcctcaagtgatccgcctgccttgccctcccaaactgctggaattagaggtgtgagctactgcatctgaataaaagtagattctctagtcttcccaggacgtaatggatctgattggccctgtccaatcagtgctgctggtttccttccagtctgctcttagctttgtatttacgttctccattattttctggagaaagactatccaaaagccatatctaaagaactgccttttggggagatttgtaaaagctacagtgttgctaatctaaatcaaatgtaactattttataattacacataaagtagattaaatgaattataggcaaaaggaaaattatttgattcttagtggataaatggtatgcaaaaggatttatattcttagtacacggtactattcacagatctgtactgttactataaacacagctacacatgcttatctttctgctatttagaagaaattaaagaggaaagctggaagcatcaaatctgcatgatgtttttgggggatggagtagggaggttgtggctatcatgggtgcaaagttgagttggcaagagtcaaaggggacttctagttttaattttaattgatgttttttcaaagcatgccattgatgtcattcacataatattatttaaaatgatgtggataggctgggtgtggtgagcccatgcctgtaatcccagaattttgggaggccgaagtgggcagatcacttgaggccaggagttcaagaccagcctgggcaacatagtgaaactccgtcaaccctgtctctactaaaaatacaaaaattagccaggagtactggcacacgcctataattccaggttcttgggaggctgaggcacaacaattgcttaaaccctggaggtggagattgctgtgagctgagattgcacccctggactccagcctggtggagtgacacagtgagactctgtctccaaaaaaaaaaaaaaaaaaaaaaagatctggataaaatcaaatggattttgattttgtcaatagtggtatgatctgggttactctctataatataatttgttatagttaaaaaaaatttgtgcttgaaatcaagatacggttgaggctggggatatgaagccacttatcttttgattaattcgaagtttacagctctatgatacaatcatatgctgttgcctaaaaatataatactgacatcttaaatgtaagttttcctccaagatatttctttctcacactgcattcttgactgagtgactaaggtttgtcatcacattctcttacctctctctaaggattctgccatatttgctcccagcacccatgtatctgatcctgatggcagtggtggcctgtctggagcagctgttgcggggatgcccgctgcagtgggggaggtgcggccagggctttgcactctacagagctgaagggagccgggaacaggcaggaattccctgcctcctaccgagttggtagacggggagcgctgtgctcctgggtgcaactgcagctgcccagctgtggctccagacccaggaatccttgtgcttttgggggcctgggaagcctccctgcccccacaggctcagaagtgcctgctcccattccctggcctctcctcactcctggcacccactccgagtttggagcaaagttgtggccgagtctgggtgctgtcgcaacccggccggttgtacacgtgcttggagaagtactgtcacaccagccccttactgctgccttggccccctctggactttgggtactgttgaacatgggaaggaggcttggagtaggggccaagggaagcttggtgtgggcctacaggcacacctctgcgatggcctgaagcctgggggctgggctgccagttctgggtggagtccaccgcccagagtgggaacttaccgtgctttttctgggtccacacatggaccaatcagcacacacttttgaacccataaaaataggtttcgaacccataaaatgtcttttgaaaaatgtcttttgaacccataaaaaatgtcttttgaacccataaaaatcttgaactcggccagattcacacagatgtcgggactatcaactgcagaaaggagctacccactttgggtctccctgacttgtcaggacaacctgcctgtggaaaggagctacccatttcaggtctcctgagcgctgttctgtcactcaatgaagctcctctctgccttactcaccctccatttgtccacgtatctcattcttcctggacgtgggataagacctcgggacctgctgaatgatgggactgaaagaactgtaacgcaaacagggctgaacaccaccccaaccccaacatcgcaccccctatgctcaccacgttgtgggaaatgaggagagagctgtggccctttaaggagcccagacctgggagctccctgagccagggctgtgacacccagtttggggctctgcagttccaggcatctccaagcttctgggtgccactgcattccctggtgcccattgtggaagctgcttgtggtatgcctggtccagcttcagcctggcagggagccagggcctgtgctggcacctggagctgcccaccccaccacagccggcatacctggctgtgcgcaatggccggacccttcactaactcacatacccctttccactccgtgcctggcttacccttggcagctgtggtatctgggccagtagcatgagctgaatgtagcctgctgggctgagtaggtggaacgagcccagtgggcccaagcaaaacttgggcaaagatgccactggacacagaggtttcgagctggaaaagtgacaccctaagtgtcctgtgacaatcctacagaaaagttgtattgctttctagagtacatttccaaatacgtattcctaacattcactttgatatggctacgggaggccttgcattgtgtgttattttctttttcttttttttttttttttaagatggagtttcgctctgtcatccaggatggagtgcagtggcacgatctcagcttactgcaaccttcgcctcccgggttcaagcaattctcctgcctcagcctcctgagtagctgggactacaggtgcatgctgccatacccagctaagtgttgtatttttagtagagacggggtttcgctatgttggcctggcttgtcttgaacttctgacctcatgatccacctgcctcggcctcccaaagtgctgggattacaggcgtgagccaccacgtctggccactgtgtgttatttggaacctccgtgtacctatgttagctttccttggctttatcagttgagattgttgcattttgaagagaacatatatccagttcttctgttttgcccatctgctccataatcactggtgatagttttgctctgagatagatcaggcctcaatgaacagattagtaaaagaaaaacacaggagaaagtcatgatgatcacattatagaggcttataaaataagaacaattcctccaatttagaagttggaggaatttttgcacgtggtgttagcagatgtgcacagcgttaacatttctttaataattttgcttatagccacaaggtgacaggggttctctttcatttgtaaactatgtctttcttatacctaggaagtatgtttacgttagaagagcatattgctgattggttgacagacagacaggctgtttcatttattagattaaaagaaacaaacaataaaagctttgtttggctacataattttatgcagcatttttggtatcaagacaaagtatcaggatggagaagatgcggagacctgtcctaattatattttgtctatgtcttggctgtaagttgagggttctaagaactggggaccccaggagacatttattcaagtccttttggggagatggggatgtagtctggacttacttgtcattgcttgtttgagattaagaaataaaattatgaaaggtctaaattaaaatgtacatattgtacctgatgtctttctgaataggggcaaatggagaaaaccaggtggagcacagccctcattttctgggaccccagcagggagacgttgcctccatgagctgcacgtactctgtcagtcgttttaacaatttgcagtggtacaggcaaaatacagggatgggtcccaaacacctattatccatgtattcagctggatatgagaagcagaaaggaagactaaatgctacattactgaagaatggaagcagcttgtacattacagccgtgcagcctgaagattcagccacctatttctgtgctgtagatgcacagtactccctaggcacctgcaacctgtatccaaacatgcagctgggtagaagtaccataacagaagcatcagcaataggggccctgagcctgagtagacgtgaagaactaaggcatgagtatgaccagagaggggaggagataaagggtgctgttcatttgactcatgtatcttttatcaggccacccttcacaaagaccgtctttgtgccttatttgaattgatcaatcctgacccttcctatcttcagcagaatcctttagtgcccaggtcagtcttctagcatagagagcacttgttctcttctcaggcctggtggaaacacatgtcaaagaaatttgaagactgttgtttttctactgtaaaatctgacaaaggaactacaatggttggaatcatatgtgaaaaatgctgtagcagtggttttcatttactcacccactgaacaagtatctctcagctcctgatatgtgccaggtactctttagtcattgggatgcattggtattgaacatagcagataagccatcatagagctcatgtttcctaagtttctgggatacacaaaggggaaaccaagtctgcctaggatttagaggttcccgagaaattgcagcaagagtttagtttcatcttcatcaatcatttttctcatggaaacatggttaaagattggggacagctgaatgctgcttgaatctgtgggtcaagaattggcttcacatgttgaggtattgtctgccagagttgaggagaaatgccaggtggttttcggtatcatctggccatttccaaacaagtctggaaagtgaagtgctacaggctgtcataaataaaacaaatctataaagcctgaccctttatttaatggaattgtggagttcaaataaaatatcaaatacgatgctattgatgaatagcactaaacattggacattattttaaataatttgtagagtagctttctgttactgtagattctagatgctcttttggggacccagctcaggacaggctaagtggaatttgtgaaaccatcagaaaggagaaaggagaagctcagtccactgagccaatgctgtaggagttctttatatccagaatacataacgaatggctccaactttatagtgccaattaaaaatatgtaaaagacttgaacaggcattttacaaggaagataaaggaatagccaataaacacatggaaatttgttctatgtcttaagtcataaaagaaatgtaaattaaaaccacgatgaaatattactttatacctatgtctaaaattaaaaagactgacaacatcaaaccctaggtttccagtggccttgctgtcctgaacaggtgcaaacagcccagagctggggaagtctacaggccctgaatatccaggaggaatagccattgccataaattgaaatgaatatgattctgggatcttgttaaaagtatacattaacttagggtaaaatatatgaattaacttagataaaatgacggcagtattatggcaagtcttcctatccaaaagtgtggtaggtttttaattcttttgtgatctccaggagagttgcaatatatccagaatatagaaagaacgactacaactttatagtaacgataaaaaacatgcaaaagacttgaatacgcattttacaaggaagacaaaggaacagtcaataaacaaatggaagtttgttctatgtcttaagtcataaaagaaatgtggccacgcacggtggctcatgcctgtaatcccagcactttgggaggccaaggcgggcagatcatgtggtcaagagattgagaccatcctggccaacatggtgaaaccctgtctctactgaaaatacaacaatcagttaggtgtggtggcgcacacctgtagtcccagctactcaggaggctaaggcaggagaatcacttgaacctgggaggcggaggttgcagtgagccgagattgcgccactgcactccagcctggtgatagagtgagactccatctcaaaaaaaaaaaaaaagtaaattaaatgagatatcacttcatactcatggctaaaattaaaaagactgacaacaccaaattttggtgagaatgtagagtccctagaacatgccttactcatataggtttaaatggatacagccacattggaaaatactcaccctatgatccagcaagtatcttttgaggcatttacccaagggaaatgtaaaaaaaaaaaaaatccactttcctgtacaggaatatttatagaagctttattcataatagttccaagttggaaacaactcgaatgttcatcaataagaaaatggagcaccaaattgtaatttattcatactcagcagtaaaaaatagactactgacatataccacattgtaaacgaatttaaaaattttagttgattgaaataagacaaacatggaacaataaaaagtgtatggttctttaaatataaagttcaagaacatgtaaaactaatatatgtgaatagaaattttaaaaagtgcttgtctgtgcagggtggagatccagtagaaggtggtgtagcattttctggggggtaatgaaagtgttctattactctattggggtgttgatttcaagagtatatacatttgtcaaaacttcagtgtacatttgagatcagtgcatttccctgtgtgtaaactctacctcaataaaaattatttaactaaaaaaccttattttgcaaggatttaaaacaatcaataaattgtatccttacattagcaatgaataagtaaaaaattagcaatgagaggcacacactcattcaataactgttttggatagacagcaaagtcactgacagtggcttttctttttgattcctgggatccttcagagactccatctctttgatgctgcagaaaactggggtcactggtggcaggtttcttgtggtaggtagatttcccatgagcacctgttttgatctgtgtttccctgcccttccaatggttgagaagcttctgatgctgtatgttaaatgccaagagagaattcagtttccctgactttaccctatttaatctaaatccttggattacaattgttgggtgctagaaatcagatgttcctaataaagcccactgttacttgggaaaataagcaatttgtgtccttgatcatatggttctgacatatttcactcaaacctactggtataattcctaagatatattctctacataaactcatagagaagaacaggatttcccccacagaaagagacagtgtggacatcaaaggaaactatgttaactcaaaaaggtgaagccattatgaaaatagagtctcttcaccttataggtgtgctgttcatataagctaaacggattacagacaaaggtccaaggaacaggggaagagggacacactggttctgaccttcatgaagataaggcacaaaggaggagggagaaggaaaagagtctcgatgcttcgacctaaacaaatccaggagagtggattctgcaggaaatatactactttcttgtctaaggataaaactttacatggcttttcagagcaatgatctctctctctctctcttcagcatttaccattttttaaaaattttattttattattatgatactttaagttttagggtacatgtgcacattgtgcaggtttgttatgtatgtatacatgtgccatgttggtgtgctgcacccattaactcgtcatttagcattaggtatatctcctaatgctatccctccctcctccccccactccacaacagtccctggagtgtgatgttccccttcctgtgtccatgtgttctcattgttcaattcccacctatgagtgagaacatgcagtgtttggttttttgcccttgcgatagtttgctgagaatgatggtttccagtttcatccatgtccctacaaaggatatgaacttatcattttttatggctgcatagtattccatttttttcataagcacaaaaggcaagaagaaggaactaaatagtgtttatttattttaccatgagctgagagtttagcagcttgggagcatttttccacaatgccagaaccttgtctttgaatctttgatgctcctctagctcactgttccaaaatggcattttaaaaaccattgctgatactgcctaaagcaatttacagattcaatgctactcctctcaatctaccaaagacattcctcagagaattagaaaaaacaattttaaaactcatacggtgctgggcatggtggcttatgcctgtaatcccagcactttgggaggctgaggctggcagatcacctgaggtcaggagttcgagaccagcctggccaacatggtgaaaccccattgctactaaaattacaaaaattagccaggtgtgccagtggggtcctgtaatcccagctactcgggaggctgaggcaggagaatcgcttgaacccaggaggcggaggttgcagtgagccgaggtcatgccattgcactcctgcctgggtgacaaagtgaaactccattaaaaaaaaaaaactcatatggaaccaaaaatagagcccaaatagccaaggcagtcctaagccccaaaataatgccacatatctacaatcatctgatctttgacaaaatcgacaaaaataagcaatggggaaagtactgcctgttcaataaatggtgttgggataactgattagccatatgaagaagattgaaactagaccccttccttatgccatgcacaaaaatcaactcaagatggattaaagacttaaatgcaaaatttaaaactataaaaactctgaaagataacctagaaaataccattctggacataggacctggcaaatatttcatcacaaagacaccaaaagcatttgcaacaaaaacaaaaaattgacaaaatggatctaattaaactaaagagcctcttcacagcaaaagaaactatcaacagaataaacagacaacttacaaaatggaataaaatttttgcaaactaggcatccaacaaatgtctaatatccagaacctataaggaacttaaacaaatttataagcaaaaaacaagaaaccccattaaaaggtgggcaaagggtacaaacagacacttctcaaaagaagacatacatacaagtggccaacaaggatatgaaaaaatgttcaacatcactaatcattagagaaatgcaaatcaaaaccacagtgagatgccatctcacaccagtcagaatggcaactatgaaaaagtaaaaaaatgacagatgctggtgaggttgtggagaaaagattatgccctgctggtgggaatgtatattggttcagccatcgtgaaaagtgatgtgatgattcctcaaagaacttaaaacagaattaccatttgagtcagcaattttgttattgggtatatgcccaaaggaatataaattgttctatcataaaaacacatgcatgaatatgttaattgcattactattcataatagcaaagacatggaatcaacctaaatgtccatcaatgatagactggataaagaaaatgtggtacatatccactatggaatactatgtagccataaaaaagaatgagatcgtgtcttttgcagcaatgtgggtggagctggaggccattatcctaagcaaactaaggcaggaacagaaaaaataaataccacatgctctcacttacaagttggagctaaacaacaagaaaacacagacaaataagaggtggacaacagacactaggaattacttgaggctggatggtgggagaagggagaggatcaaaaaactatcttttgggtactatgcctatgatatggtttggctgtgtccccaaccaaatctcatcttgattttagctcccataattcccactgtgtcatgggaggaacttggtgggaggtaattgactaatgaaaagtgtgggtttttcctgtgctattcttgtaacagtgatacgaacaggaggcagggaaatactgggtagaagaaggtgcttccctggtaaaggccccaccctctagactggaaaccgtggccctaaatgagaacagttatctcagttttttcaccgaaatgttgccttttgggcccaacctgcccccctatcctgtgccccatataaacctcagacgtcagctggcaaagggacaagcagctgaacattgagaggagaagaagcaactgagtgtcggagactatggatagacatggcttaacttcagacggcatgacttcagaggggagcctggccagagatggctgggcttcagggaaaaagatcaccttcttcccacacccatctcctttccagctccccttccactgagcgccacttccattgcttaataaaatcctccacattcatcacctttcaaaccattagagtgacctgattcttcctcgacgccggacgagaattcgagatgcactaggtgcaggaacccaaaaaggctgtcactctgactcttcactgagatgtttaacacttaagctgtccgaagatggcaaagctaaaagagcattaactgtaacaaacccctaaatgctgccgtggggccagagcccaaaagcactcacctcagccctggcacccacttgcctacgtgctcatttctgtgaggggttcagcacagcaggtttgagcaagcgaagttcatccctgcaggcgctgaagtggctggctggacccagagctggtgcactccagttcctgcccaccaaagggtcaagggaactatcccatctcagtagcgaataagtctcacgagatctgatggcttcataaaggagaattcccctgcacagactcttttgcctgccaccacgtaagatgggactttgctcctcctttgccttctgccatggttgtgagggctccctagtcacgtggtactgtgagttcattaaacctctttttctttataaatcactcagtcttgagtatgtctttattagcagcacgaaaacggactaatatagctcatcaccttggtgacgaaacaatctgcacaccaaattctgagacatgcagtttacctatatagcaaatctgcacatatacccctgaaactcaaataaaagttttaaaaagtcatgactacaacataaatcacctgagggaactttttaaaaacacagcttccccaggacagtctcatagaggttatgtcagtatgaataaggtggatcacagaatctgcatttttactatgctcccttgctgattgtgatgcaaagctaggttcaagaacccatgctgtaagatgcttctgaacatcagctaccatgtctccatgtggtagaagagtgtttgaacttgctttccagtctttggaagcaaatcaacatcacccatatgtttaatcccctatgtgaaaataatttatgtatgtacatgtttttatatgccatctatactaaatgctatctaccaatcatctatttatctaccaatcatctatctatctattatctatctatctatcacctatctatctatctgtctgtctgtctatctatctatctatctatctatctatctatctatctatctatcacctatctatccatcctattggttctgtttctctggagaaccctgactaatacagacagtgtcctgggaataaaataagcctctgaataaatagcaacaggtgttcttcagatttgaaaatggtcacctggcagctgaatgtgacttgaaaatgaggtccaaggtaagcatgtggcactatctttcaggagaaaacgttccttgcagtgtagtcccttgcctgtgagggggcacagcttctgaaaacaaatacatctcctgctaaaatcttaggttcatgttcagcattttattgagatgacaatattttttatgctatgcagttaagaattgaggatgccagaggttttaaagatggaattttcaccaggtccagcgattacaacactcgtaatgtttggtaagtttggggaaaataatatgcctgttaaaatttggatttttaaaatttgttatgtcagtataataaccacaattttgtccaattcaaactcagggtgatatgcagctttttatttctgaggaggaagcagtagagactcagggacctggatagaaagttagtggccttctcagaaggagctctccctattgtaaactcttcctatgccaccatggtgaacctacccttttctggttatgttcaatatcctggtgaaagtctgcagctcctcttgagaactgcaaaggaaaatgagaatggaagcaacaaagactttgaagtcacatatcacgaagaaaaaaaaaacacctttcagtgggagaaactttgagcttaagtgtcagatgtggctgcttcatgctgtgctgtgagccaaacacaccgagtggggctgcaggcgagctgagacaaggttcagtggcccaggcaggaccttgctgctgaggagctgctgcatgactcttgctggtttaaggaaaacgtactgtggtttgaccttcagacactctagcagatgtaaagatcacctacatcgactctaaggacacagcagaagaacgggaagtgaatatggcctgagcataactctccttgtagaaagaagaaacagggtctgacatccttttccagagatcagtgaagtaagctctgtcttcttcttactaagttcagccctgtggctttgaccaagggcacctaaagaaatagtgatgtatagtatattgttttctctttagagatgcaacatgaaatatgtaaggttgcatctgcataatgtctccctggaagagggagggttatttcctagagcacataaggaagaaccccaacgcaactagttgttaaaaaaggagaaaatagaagggaagaaggaggaaaaagagagtaccacatgtaaacaaagaatggactgagagtgacatttgtcatagtttgttttgttacaaatcaaatagcagacatgaaatggtgccctcagaaaagtgaaaacaagcacataatttgtttgtggctcaagaagacatgaagaagtggctcacgtccaaatcctacacacattcctttcccccttctctccttctcactatatattggttagctggcttagtaaagcaaatcctaaattgagacagatgggtggtgccgtagagcctgatgaaggagaacactcaagctcaaattcttcatggcagtatagctcaggaatggtggatgggggaaatgctatagcttcctcaactccttgtgagcctttccttctcctcaaggagaaagaagtttaaggtagccatgtgggtaggggaagaaaatggaggagaaagagtacgactctctgaattgcattgcagatatacctgaggtctctgtaaatattggagtaacttttcttgtctagtacaggcatttaatgaatattcattttgatccataaaaatgaattttattttcaaggagaatggtgcttgttaagacaggaggatgatagagccattcatggtgtctcaatagctcagggactgaagtgaagcaactgtaaaagtccctaaaaatgttattatcagcgaagggtccttatcctcaatcttccccttttctctgtttcccttcctaagttttttctaacattttcttttatcactgaccctctctctgagtcttatgaatgagctgaagtaataacccctctctaattttattttctaccttttttttttttttaccagttctgccttcttagtttacatttttaaaattctcttttaataaaatattacatgtgcatgggtaaatgcaaaacttgaaagagagaaaaactgtacaattttaaaaagttccagatttttggttgaacatggttgattaaatattcatgtttattctctgctccctcctgaggccctagtgaaatgctaataaagaagttcaaagcctgtatgaacatacaaacacaaagtgaactgaaaagatggtgacagcacaagagagatcaacataacgttgaaggcgttgaaagcaaatggagaggtgacaaactggtttaaccaagagagaaaacctgtgcctgtagaggggaaagctgagagacagcagtcctgtgcattctgcagcattctggaaatgctcaagaattagaagcatcaattttgatggggaaaaaggcatcaggtgtggagggtagatgggaaagaaataggaagattaatggaaagactagcctcaagaaggagcagttggaacccagtgtaaccctcctatgtcctttgccacactgtaccacaggctgcaagctacctcaaatctggtggaagattaaaggttgaatctgattattttgaactagacagtctctggattagagaatactagagatatctgaggatgaaatgaggtgccataggcaaaacagggggattaagtgaaattctatatttctagtgttaagtccatcagctcctgtgcccaattcagtttaaaattctagttttccaaataatttttcatcagaatctaatatttgttgatgctgatgagaaatctaattccagtgggttaccccaattggagatttttttacttttatctccatacacatctggaattttttcccaacttatccttggtgttctagttttgctagaatacgtttaagtgtaagtctttttaattcagtgataatcacactttgcgggctattttcatctgaatatgcaatgtccttcagttgtgggaaaatttgttctatcacttctttagtaaatctctctcttctggttcttttttctaggacaaatattatttgcttgttttatctccaagattgattttctatgtagtagtatatttcagtgcatttttgactctttttcttctgtgtcctgagagattttctcaattttgtttttcagaccatctgctgatttttataaagttttggcaacaatagtttagtttttaaagagctctttgtggttgttgaatttttgttgttgattcttttaggttacatgtaactagatatttttgaacgttctcttttattcttagaattttgtttccctttgcatcagggtttctgattcttttcttgatatttatattttttgctttatactgaggcctagtcctccctgctgtcccttcatattataagaaggaaggactatacagctacaggtatttcctgtgtcattgtttatgtaggtctgttttccaataggtttccttgaagatgtgatttagctaaggaccttgagataggaaaattagcctggatcatccaggtggactcagtctaatcacatgggtttttaaaattggagaaacattccctgctgtggtcagagggagacgtgactatggttgaatgatcaaagagatgaaacattgctggctttgaagatggagggaggggttgcagaccaagaaatatgtgcagcctctagaagttggaaaacagactcactcctagaggcttcagaaagttataatgctgataacttgattttaactcaaaagagactcatgttgaacttctaacccacagagctgtaaaaataactttgtcttgttaagacatcaagtttgtgataacttgttatagcaaccgtatgtcaatttgcagctttttatttagaatatgtgaacaagggtttgatgctgctttcaacctcctcactcttgaacccctcaaactcctccccactctccaccagtgcaccaatgccagattgaagggttactcattacaatttatattgtagtctctcatatttgtgttttttccccatgacttccacttctgtagttaagtcatcatctcctttacatttttattcttttatcagtgggaattttggaaagataggcagtgagcaggtatggtcatctgatatctggaattagaagcattattcatggacttcttataagtgagagacaatctacaggcaaaaagaagcaaggcaatgagaatcccaaggacagatttgatttcctgttgctagaaacaatcacagtcccagaaaagatgctttctaactttagaaaaaggtccctattgccctgaggaaaggcagcgtgtttctctcttctcattttccctaaaattgatctcctggtgtgacagttactcgtttagccccagggtctacaggctgaagtgggagggaagaaaaggcctctttcagaagaacaggcttctttcagaaggacagccttgctattgccacaatcaacactatcttgttttacaagacttgactcatttatgtaaaactactggttgcctatctatgtcagatttcatgatcaaacagctcacatatctttttttcttttagatgtttttcttagctctggtctgctggtggtactccttcttggattccagggtaaatgcaaatgtatttttactctgtccctagttccttcagaaattatttatattttactttgcaatgccttcatcaatcctctcagttttttctgtagatactaaagtctatcaatgatgtcttgatgatgtagtacccagaattgggtgtaatactctggttatgttcccagcaaatagcaatgttattttactctcttatctgaatatcatattataatttttgttgatctaaagccactgtatctttgtaattctgcttgaagaagacaaagataatcctactttcttttcctagatgagggctcatgttctaggtgtcaggcctctgagcctaagctaagccatcataacccctgtgacctgcacgtatacatccagatggcctggagcaactgaagcaccacaaaagaagtgaaatagtcagttcctgccttaactgatgacattccactatagtgatttgttcctgccccaccctaactgatcaattgaacttgtgacattccttctcctggacaatgagtctcaggagttccccaccagaacaccttgtgacccccgcccctgcccgcaagagaaaaccccctttaactgtaattttccactacctacccaaatcctataaaactgccccaccccatctccctttgctgactcctttttaggacttagtctgcctgcacccaggtgattaaaaagctttattgctcacacaaaacctgtttggtggtctcttcacagatgcgcataacactagacttttattttgtacatctgatcttatttttaattttaccaaagtaggtatctccacatcctaccgcaacctcctctcaacctgatgctcactgcaacaagaccatttaaagctcagtcagaagagttgatctaactatttttgcttaaaggatgtctccacagcttttatacaaagatactgagggactccaaaatctgctagattcattgtgagatctttttctctgtaaattcctcctctcttttacagtcctcatttttcattgaggctaggattaatgtaatatactacagagggcaacacagtacagattagggaagaaagaaatgttcactggaagtttttgacatgtctccaaacaaggaaagcacaggttcacttcttgtggggagtctgtatcctcagtcctgaatctggcctccagagggtgacgttgcacaagggacagatggctgtttccaatgatgatcaacaaacactttctgctcagccccttcttcctgcagctggcttactgaagcaccgtcactggagttctttgaagatgggacaaatggagagaatcaaagattgaaaagcacttaagattatctcagcagattttgtattcttaccaaaacaagagacttgcctagcccaaccttcctcacgctcgctattctcaagacctgggttccagccactttcctactggccccgaggagaatttccaaagagacgcctgcagtgtttccacagctcagccatgctcctgttgctcataccagtgctggggatgatttttgccctgagtgagtaacattctattatggtctctagttccacagaagtaactgttttctgattcaaatcttagtagaaatacttttcatagacaagtctgcactattttcactgatacaacattgattttttcaggagatgccagagcccagtctgtgagccagcataaccaccacgtaattctctctgaagcagcctcactggagttgggatgcaactattcctatggtggaactgttaatctcttctggtatgtccagtaccctggtcaacaccttcagcttctcctcaagtacttttcaggggatccactggttaaaggcatcaagggctttgaggctgaatttataaagagtaaattctcctttaatctgaggaaaccctctgtgcagtggagtgacacagctgagtacttctgtgccgtgaatgccacagtgtctgggactgcaaagggagctgaacacaaacttcctaaggtgctagggagaataactgcctctgaaagattttggattctgtcacagtagaaaccatgatgttagtatttttaaaaaaatttatttttaatttttatggatacatagtaggtgaatatgtttatggagtacatgagatattttgatacaggcattcaatgcataacaatgacatcacgtaaaatggggtatccatcccctgaaacatttatcctttgtgttacaaacaacccaattatacacttttagttatttaaaaatgtacaattaaattattattgactgtagctaccctgttgtgctatcaaatactaggtcttatttattctttctatttttttgtacctgttaaacatccctcctctccccgaccctcccactatcgttcccagcctctggaaaccatccttatcttctactctctatcactatgagttcgattgttttgatttttaaatcccacagataagtgagaacatgcaatgtttgtctttcttgcctggcttatttcacttagtgtaatgatctccagttccatccatgctgttgctctaacccaaaagcatgtgagacgggtctcaatcaatttagaaagtttatttcccaaggttaacaacatatctgtgacacagcctcaggaggtcctgacaacatgtgcccaaggtagctggggaacaggttgcttatatacagtttagggaaacataatacatcaatcaatacatgtaagatttacagtggtttgatctggaatggcagtacaacttgaaggggagcttccagatcataggtagattaaaaaattttctgattggcaattgtttatcaatagaaagcaatatctggggtataataaggggttgtggaggccaaagttttatcatacagatgaagcctccacatagcaggcttcagagagaatagattgtaaatgtttttatcagactgaaaatatgtgttgatgttaatgccagtcagcccttaaattccaaaagggaaatccaaaagggaggggggtataaatgaggcatgtccaatcaccccttcccattgtggcccgaactattttttcaggttaacttcggaatgcccttggctgagagaaggggtccattcagatggttggaggcctgagaattttgtttttggtttatattacaaatgacaggatctcattcttttttgaagccatgatgttcttattccacagtacagagatgctcagggacttgccaggtgagtgtgaagttgctatattttaaatggttgagtatggaaattgtgacatggcacagagttttgcttttcattcaccattttatctttcaatatccagaacaaaaggtgaacttccttttgtaagcatatcttcttgcatacttactgttctttcaacttggtaattttaaagtagtttccctggagtcagcactctgtgctgattattttctctcctttttaagtgcttcatttaggaaggaggagatttattaggatgctggatggcttagaacaatggcatgctcatgtacagtctagtaaccttgtcaggaaaactgaagaaaggagagtgaataactcaaattccttagtagtttttacagaactattttttttttgagacagagttttgctctcgttgctgaggctggagtgcaatggtgcgatcgtggctcactgcaacctccgcctcccaggttcaagcgattctcctgcctcagcctcccaagtagctgcaattacagtcatgtgccaccttgcctggctatttttttgtatttttaatagagaaggggtttctccatgttggtcaggatggtctcaaattcctgacctcaggtgatccacccgccttggcttcccaaagtgttgggattacaggcataagccaccgcgcctggccgtaaagaactattaaggaggaacaaaatgctaggtctacttggaaagtcctatttattttttgtttttcccacttataaagaccaattcttattcttttgattcttaaattctgcaaatccacattataaatcttcaaaattgatgaaatagtaacttttgccaattcttccaaatgatgttattttagtttttactcttattccagtttcatatggttgtacagttggaatattagaaacgaattcttatctgtttaacactgccataattaagtgtgtgcaaaatttagcaatgtctggcccctgaagacattctaattaagtattgtaatgggaataaaaaggtcgaagggcatgtgatagatatatgacttctcctggttaggaagaaaaaaaatgtacaaacactttttaagcttcttacttgaagcctttaaggttaataatgacttgaagaaacgtaaagagaaagaggaggaggagggttgggcttttttgttgtgtacctcctgatgctgtcatgagtaagaggaataggaatttgaagatatagataataatagtggattgtttccagtgatttacctaagccaaaggggacaccagtagggatcagcattatttttcaggtcatagtgttatggctatttgtggtatatacctttgggggatttctggaaatgaagtaagatatataaaattattgataagaaatatatacttatttaaagtcttgttcttcagattatattctctactgtccccaagagactgatgatcttcataagacttaaaaacacagctaagtcctgtgttccagaatgactgcaagcaggtactttatacactacatatgagaaggacaaatggcaatttctttcaattccaaactgaagctcagtaccgaggaaatataactgctggcaccaagaacctcaagcacctggaaatgcattttctgctctcacaccaacaaccttgtttgagatgtcagagtagttctattgatatgattgttttataaatgtaaataactttatataatatagatattaaggagaaggtagaaatatttaacttctaacacaattatatttgccatatgaggagactgtaacattttaaacaatattatattatttctatctcttgatatcaataaatacataaatgtaaagtttcaaattttaaaaaataaataaaacattacagacaaaattgccatctcttttatttttttcctcagttttaatgccttcatccctctctcaaaataaacctattatgaacttttttctcaactccatgttttcatatttccaaacatagattttttaaacaatctgtggtgctgtgttttgtgtttttaaaatttacatgaatgtaatccaattgtatgtgtaattgtgaaacttgatttcttccctcaaatatttttcagatatagaaaaatttatatatgtagtatatttcatttcttttagctgatacatactattccattttatggatatactatatgtcccttttgatgcacattggattgtacatttacaaagctcaataggccacgtaagtattggtttccctcataccctgagtgttttcaagaggagtcctttcagctgtctatacagttcacagattactctttttgcaatgcctccctcccctcctcccacgtcaagtgctaaggtgcgagggaataagaccgaacaggccatccagacttagaaaccccataccccaaatagaaaccggtatctcctgtaacagttataaaagtcactgctccagaactatgacatcttaaaaagtattcacagtccattcacagttcagatgcagtttatcagtcaggatcatttttaccataaccatcttacttggtaatccagctgacgttctacctttattggatttccagaaaaatagagattagaaagttaatctaatttttttcatgtggaaggagaaaagattttgttaatcctttattcaatgagtgtttctgatcttttattataaaaattctacaaggaatacaattatgtttccttatacatagatatagaatgttttatgttatacacctggaagtggcatttgctgggttatatgattcacatctttaacaacgtacttgcaattgccgaattgctcttgaaatattcttacctatttttccctcattagtagcacagaagaattcctgtctctttacacccttgcaaacacttattatttcttatataacatcctgccctctctatctgtgtttcctgcatttctcaagtaaagtacgtatagtcattttttcaagatttgcttctggaagaacccaatataagagatctggtacagaagtggtcatagagaacaaatacatagaatgagattttggaattaaattattcatggccagaagggaacaaggatcccattattagcagtaggtgcagtggtaatagagatgctaaaagatcatagcatcacaattattaattgtggtgaattggcatgggattcatgtgtaagttgttgcagtagcttatgtgatatacttagcatttgagaagtattgtgataatggtaattttatgtgctatggagctggctatttattgtcaagtgccatcagggaagagcaataacaaaatggaaccagctaagaccactgcatatttcaacatctgtattcaatggtgatctttggaagacaatggctgctgcttcccatctgcctttcaaatcttgtgtaaatgctcttttgtattcagaaggggattctgggcactgtattttccagtgcagctacatcaacaatagaacaatccaacatagaaagccaagagccaagttcactggtgtgctacttagttcaccagtgtgctatgttgcacattgtcaactgggcttctttctcgtcccctttaatatattcccttgctttgctagggaagaaacccaaactacaattcacacaatccctttcattcacttagttttaattctacaaatgagaggcatttgggaataatatcaggcaagtagaaaagaaagagaaaccattattcttctgtagggactgtatgcaggcagctcagattaccagctgtgaggactttgtttgacttctgcgtttcttcctaagaatcactcattttggtgtcacaggcagctggatgatgcatcacacctcaaaatttcctgtaatcagtctttctcatctttgttcattagcccctccaatggttgtatgtctaattttgtgtattaaatcttactttttaaaagagttttaaaaataacttttactttagaaagttaatatgtgcattatagaaagctgagaaacacaataagcaaagaacaaagtcattcaccatcacaagcactttatagtttgatgtgtccttctgggtcctgtgtatgtatatagacaacatccaattttatgtgtgattgagatcatacagtatatatgatgttttttcacacatcatgaatatttaccagttcaaaatcccaaggctatatgagcattttgataacaaggaatataccacatcaactcaatctgttagaaaaaaagtaatcctgcctttcttggggacaaaaatttcaaagaagacaaaaatggaaacaggcctctaggttaaaagtaccgtcagagttacaattaaaataccacattccctttaatggtcaatttaaaaagagatgtaaagcaacagagtatactaagtataatgtttctaagagaattctttttctgatctgtactattaaatattagcaagaaggtatgttttcattgcattacttagtgtattcctatagtacagccaaaagagatgcacatacatcaatagctattatcaaaatgtaaatataaacatatctgcttacacctgtccctttatacttccttctgcccttcagctgccaatctactgaacacatcctgatacatacactgctcagaggtggtttaacaacaattccatgtccaaggtgcagcttttctatcaagcataaaaaatacatttacaaagtagctaatccaccagctctactttttctcatacgttgtcacctcagggcatctataaagcttagatgttgcaaaataaagactgaactttatccacaataaacacaggcaggttacagaaaatgcatatataaatctatggttaaatccaaaaaagtcacctaagtatggagatattagcaaagaggccttccctccatccttcctcttctttcaccattctagtgactaagtacctgattacatccagctccaaaagaaggattaacaaaggtcactgccagtagataggccttcttaaaaatgaacaaaaggacttttagaaaggcgttattttactacctctacctttaacatactttgggcattaggacttgtttatcttttaatacacagcaatattaacaaaaacacatacagggccgggtgcggtggctcacgcctgtaatcccagcactttgggaggccgaggcaggcggatcacaaggtcaggagattgagaccatcctggctaacacggtgaaaccccgtctccactaaaaatacaaaaattagcgaggcgtagtggtgggcgcctgtagtcccagctactcagagaggctgaggcaggagaatggcgtgaacccgggaggcggagattgcagtgagccgagatcgctccagtgcactccagcctgggcgatagagcaagactccgtctcaaaaaacaaaaaacaaacaaacaaacaaacaaaaaacaaaaaccacatacagaacaatggttagacgatctgaactaatctaacttacaggcacaaagcttctctctgcatacttccttttctccctatctcccagcatacaatgaacagtcagcaacctctctaagacatcaagtttaacagttccattccccaaatgcagctagtcctgtgaaatcacaaaaaatactcaaagagtgtcactttagctgtcttaatgtacatactttaacatatgttatgtacactttgaaatatctagaaagactagattttcatataagaacttaagttttccgttatacacagagtagcattgaattaactactaatgctataatgtgatagagttagtttactaactctatacctttgtcatacactggtaacctctttagcatctagaaagactagatataaattaggattaatttgtcctttatatacactatatacacagataaggaaaacaaaatgcacagacgtaagagacaatggctaatgttgcctcattgtaagcacattgccacagaactctttacacttccttctcctcccaggagccagcacacaaacataatgtgtattactcaagaggtggtttggccattcccctctccagcccccagtcaacatttcatatgaattttaagaaacagatatttaaaaaatttgttattttctacctctacttttgacagctatgaagcactttagaacatcaagaaaggcaagatagggcaggcgtggtggctcacgcctgtaatcccagcacaccactgcactccagtctaggtgacagagagagactccttctaaacaaacaaacaaacaactacaaaaaaaccaaaacaattagccgggcatggtggtgggtgcctgtaatcccagctgcttgggaagctcaggcaggagaatcgcttgaacccaggaggtggtggttgcagtgagctgaaatcattccattgcactctagcctgggctacaagagcgagactctgtctcaaaacaaaaacaaacaaacaacccccccaaaaaaaacacaccaaaaaacaaaaaaaactagatctatacagagcagaggcctcagaaataacgccacacatctacaaccatctgatctttgacaaacctgagaaaaacaagaaatggggaaaggattcctgatttaataaatggtgttgggaaaactggctggccacatgcagaaaactgaaactgaaccccttccttacaccttatacaaaaattaactcaagatggattaaagacttaaacataatacctaaaaccataaaaaccctagaagaagacctaggcaataccattcaggacataggcatggacaaagacttcacaattaaaacacaaaacgcaatggcaacaaaagccaaaattgacaaatgggatctaattaaactaaagagcttctgcatagcaaaagaaactatcaccagagtgaacaggcaacctacagaatgggagaaaacctttgcaatctacccatctgacaaagggctaatatccagaatctacaaagaacttaaacaaatttacaagaaaaaggcaaacaacctcatcaaaaagtgggcgaagggtatgaacaggcatatctcaaaagaagacatttatgcagccaacaaacatgaaaaaaaaagctaatcatcactggtcattagagaaatgcaaatcaaaaccacaatgagataccatctcacgcaaggtagaatggccatcattaaaaagtcaggaaacaacagatgctggagaggatgtggagaaataggaacgcttttacactgttggtgggagtgtaaattagttcaaccattgtggaagatggtgtggtgattcgatctagaaccaccaataccatttgatccagcaatcccattactgggtatatacccaaaggattagaaatcattctgctataaagacacatgcacacatatgtttattgcagcactgttcacaatagcaatgacttggaaccaacccaaatgcccatcaatgatagactggatgaagaaaatgtggcacatatacaccatggaataccatgcagccagaaaaaaggataagttcatgtcctttgcagggacatggatgaagctggaaaccatcattctcagcaaactaacacaggaatagaaatccaaacactgcatgttctcactcataagtgggagttgaacaatgagaacacatggacacagggaggggaatatcatacaccagggcctgtcgggggagggggagtgggggagggatagcattaggagaaatacctaatgtagatgacgggttgataggtgcagcaaaccaccatggcacatgtatacctatgtaacaaacctgtacattctgcacatgtatcccagaacttacagtaaaaaatacataaataaaaataaaaagaaagacaagatatttcaaaaaaattcttagcattgtcaacaatatatacagtagtgaggaataaaatgcgcacataaagcagtggttataatatgaaaatgtctcctaagcatgaccagtctggaaaagaaccttctcttcattctcactgccttctgctccatggcctctaacccactgaatgaacgtggtggtgtgttgctcctggagtcacttctacagctcgtctaacaactttcgtttcaaagagtcatttccagaaggcgtttgctttctaccattttttaaaagaacaaatgggcatttacaagacgtgattttcttttttctttattttattttatttttttgagatgggctttcactcttgttgctcaggctgaagtgcaatggcgccatctcggttcactgcaacctccgcctcccgggttcaagcgattctcctgggattacaagcatgtgccacctcgctcggctaattttgtatttttagtagagatggggtttccccatgttggtcaggctggtctcgaactctggacctcaggtgatctacccgcctctgcctcccaaagggctgggattacaggtgtgagccaccgcgctcggctgacgtgtgattttctaactattatacgtcagcaaccttttaaaatctagaatggctaggtagagcaaaaattttcttttaaaaggttgagggaaaagttgagagcagctttttcatattatttacctgggccttctataaaggccagtaaatcctcccaaatggtggggggcatttccagtccaccaaatgtggcatgtgatttctctctttgggtatcaaggtctggtagaacaaacggcaaccacgcaatggcctgctaaccactccacctgtccttgtgggggctctgctcaccttctaggcccttttaggcctttgtccatcatttctggcatttttgggaggaggtaaggtcttgtctaactgggacaaagtggtcagcccgggacccgcatctgtgcaactccatggcataatgaagttcctgagcttgtgtctctaggcccaccttcttgggttctgcaaactactgcagccctcagcgccttctggcggccgccattcttcttcctctgcgacatccatttcctcccaaaggcacggtgtcctccgcagctcggtgagggcttcgccaaggcgcagcaggatttctagatgttctaaagtgctttatagcccagcgaggtctgggcccagagaggctgccgccatcagctcactgaagtggggagagaaggaggtttgcagggccccagctcacctgcctctcagtgcgctgcttctcaccacattgtctgcctgaactctaaatgtctttctactgaaaatatttggattgttttatgaggagaccgaggaccacctcgtggccatcaagcagatcatccagaggcaaaactccttgtctgaggaattcagaagtaattattaatcgacgtccctattatcaaaagcaggcatctagtaccgggcttctttcccaaaaatgtataagtaactagaatttctatacatctctggaatgcatgtatgttgaaacttattgtgcagcccttgctgacatcaaagcaccaaaatgtctacaaatgtaatcatttatcctgacctaggtggctaatatggtccaaattacccttaagctcctgctttaaggttcataaatgctcctaaggaaaaatccacggtggcttgctcagtccgctcttgctgaagcgccctgctgcactcctctgcagcactggttctaataaagctttccttttcaaacccacactgttgtgggtaaattcttattaccatgagccaatcactttccgttgctgtggcgctgacacctcgcccagcatttctgtttgccggactgcctctcgactgacaacagatctgtataaattcaagtccttgaagcggagcttctgaggcttgcagtcagaccatttggataaatctagtatcagctgggaatttgcttaagcattttttcattgattacacagttctaccgtatttcactcaaatctactgctacagttcttctatggtattcatctccttttgaaatcatggtgatatggcttggacctgtgtccccacccaaatctcatgttcaattgtaattcccagtgttgcaggtggggcctggtgggaggcggttggattactggggtgggccattcatgaatggtttaacaccattcccttggttctgttcttgaaatagtgagtgagttcttgtgagatctggttgtttaaaagtgtgtggcaccttcctgccctctctctcttgctcctgtttctgccatttaagatgccgtgcttcagctttgcctttcaccatgattggaagcttcccgaggctcccagaagcagaagcctctatgcttcctgcacagtctgcagaatcatgagccaattaaacctcttttctttataaattactgagtctcaggtatctatagcaatgcaagaatagaccaatacacctggtgtggaaaatagattccctcaaaagaatggagggttgttacaatactaaggacaaggtttccgtggaaaaagtaaagaaagttaggaacagtgaaactgcttgctctatatttctgtttagacttcaggtagagtcagttagatgaatgggccaaaagaaccaggaaaaggaggaagatgcagcttgatcacagagatctgacacagggtaagagggaaaaggaggagagcctttgtatagagccaaataatatccagatctaaattttcttcccaagtttagagtttgttaacatttacaccttgctgcagaaccatgtagctgctgtctctgaattcatggagagtgaatattccaggaagcacaatggaaggcgtccaggttcaaagataaatggtagtggggctgacagaaaaacagcatccttcttaccaagtttgtcctgggaacatccagagatttttattataagtcgactaaacaagaatagtgagagttaacagcaattgttttagctactgtgacttcagtactaccatgaaaggagaatctgtgaggattggagttttttcctcatgctcatcccacaagtgcttcactgataccttgtctgtctgcttaggtcagtgttctcaaagattattttgtgaatgtgtataacactggctgtatgacaaacacctgaggagatttttaacttccaggatcttgattctgaacattttgattttgtaagtgaggagatctccaaatctgtattttaaagatgatcaccaactaactcttacatgaagagaagtgtcatccttgctatgattctatacatcagcagacatgtctctaccaatcctagaagctgagatgggctttttctttggtcttttgaggcaaatccaaattatttaagtatcttatcccgtggtaaaaataactattggtcaatagtattggtggatggacatatgtagggggtatataatcaaggctaaatttccattaaaaggttagtatcacaacactttgcctcatgcacataggccagtcacattatctgggaatcatttcttctcctacaggagaagaaagtgatgccagataattttgtagggatttaatgactttagttactatattttttcattataagagttatatattctttactttttaatcaatatatacacaagatataatttccttttttctttgaaaagaatttattaattggaaattacaattaatttatttctgtaattgatgccttaaatgtgaagcaatatgatatttcaagtagtaacaattcctcaaccaaagaccattcatttattcatgcatttgtgtatttaagaagtgtttcctaaccacctgctgagtgtttgacattgtactaggtatgggaatacagcagtgaaaaaaagcttaagtctctctcatctcaaataatctactaatgtttaaacatgtgctactgacattcctctggttttatcctaaaaaagtgctaatacggtattttagtggatcatgggttgggcaaagatggctaaataagaaaaggtaaaatgaattattctcagaaatgccatggtatgaaaagaacttgcaagtcagacagtgtgctgttaaaaaaaacagagttataaaaaagaccaactattctttagatatacaaagaactatcagacagctaataggtgtcttagaaaaaaaaaaaaagccagaagtgaagatacaggattgacttttgaaagaacagtcaacaatcctttgagtttaggatcttgcccacaaaggggtgcatcttcctaacacattcacatttcctgctcacgctcatttcttcagtgtgaccttaacttttcctcacactaagaagacaagacccaagggcaccagagggtctaaaaatgaattcttctccaggaccagcgattgcactattcttaatgtttggtaagtaaaatggcacttaaaacttagaatcttttgttccattatgttgatgtaatctgtaaccacagttttctctaacgggtacagctaagatcacgtctaaggtaacttggtataatttgtttatttttttttcagggggaatcaatggagattcagtggtccagacagaaggccaagtgctcccctctgaaggggattccctgattgtgaactgctcctatgaaaccacacagtacccttcccttttttggtatgtccaatatcctggagaaggtccacagctccacctgaaagccatgaaggccaatgacaagggaaggaacaaaggttttgaagccatgtaccgtaaagaaaccacttctttccacttggagaaagactcagttcaagagtcagactccgctgtgtacttctgtgctctgagtgacacagtgacagggactgcaggggaagctgagcacaaactctgagcagcacgaggggcctggctgctgagtgtaagccactgtgatcccctctggttagggaccaggaactactctactattgttgcccaccacccaccctaggcactcctagtgtgaaagccatccaaataaactctaaaacactatagaataactaaaagtaaaaatacctcacaccagatgctttaacaatgagagtgaaaacagaatgtcaccatagttcctcaaccttgtttgaaatttgtgattttaaaagtataaaaccttgagataaatgaaatggtctagctgctcatccctgtataaaatgtagcctcctgaccttgtctcaggccatccaaggaaatagtatgcttacagacacagctgtgacagatgaggttgcaaatgcttaatgcatacctgagtggggtatacattcagctggggcaagatggggtgatttcttaggaaagcttctgcccaagaaataataggttcttaaagaaaaaaagaattataaatggaagaagtcaaattttccttgtttgcagatgatatgattttatatttggaaaaacatagagactccacaaaaaaaccttagaactaaaaattcagtaaagttgcaaaatacagaatcaacctataaaaatcagtagcatttctatatgtcaacaataaacaacccgaaaaagaaataaaaaagtaatcgcatttatgatagccatgaataaaattaaataactagggattaacttaaccgaagaagtgaagatctctataatgaaaagtataaaacattgatgaaagaaatcgaagaaaacaccaaaaaaaatactccgtgttcatggattgtaagaattaatattgataaaatgtccatactaccccaaacagtctacagattcagtacaatccctaaaaaaataccaatgacattcttcacagaaatagaaaaaaaatcctaaaatttatatggaaccacaaaagacccagaatagccaaagttatcctaaacaaaaagaacaaaactggaagaataactttacctgactttaaattgtactacagagctatggtacatgaaaacagcatggtactgtcataaaatcagatacatagaccaatggaacagaatagagaacccagaaacaaattcacatatctacagtgaactcatttttgacaaaggtgccaagaacatacactggggaaatgacagtctcttccataaatggtgctgggaaaactgtatatccatgtgcagaaggatgaaactagacccctgtctttcaccatatgcaaaaataaaatcaaaatggattaaagacttaaatttagatcacaaactctggaactactacaagaaaacactgggggaaatctccaggacattggtctgggcaaacatttcttgagcaatatcccacaagcacaggcaaccaaagtaaaaaggggcaaatgttatcacatcaagttaaaataccctacacagcgaaagatacaatcaacaacgtgaaaagacaatacacagagtggtgaaaaatatttgcaaactacccatcttacaagggattaataaccagaatatatgaggagctcaaacaactctataggaaaagatgaaataatctgattaaaaaaacaggtaaagatttacatagacatttctcaaaagaagatgtacaaattgtaaatgggcatatgaaagggtttttgacatcattgaccatcagagaaatgcaaatcaaaactaaaacgagatagcatctcatcccagttaaaatgatttacaagaaaaaaacaaacaaccccatcaaaaagtgggtgaaggatatgaacagacgcttctcaaaagaagacatttatgcagccaaaaacacatgaaaaaatgctcatcatcactggccatcagagaaatgcaaatcaaaactacaatgagataccatctcacaccagttagaatggcaatcattaaaaagtcaggaaacaacaggtgctggagaggatgtggagaaataggaacacttttacactgttggtgggattgtaaactagttcaaccattggggaagtcagtgtggtgattcctcagggatctagaactagaaataccatttgacccagccatcccattactggctatatatccaaaggactataaatcatactgctataaagacacacacacacgtgtttattgtggcactattcacaatagcaaagacttggaactaagccaaatgtccaacaatgatagactggattaagaaaatgtggcacatatacaccatggaatattttgcagccataaaaaatgatgagttcatgtcctttgttgggacatggatgaagctggaaaccataattctcagcaaactatcgcaaagacaaaaagccaaacactgcatgttctcactcataggtgggaattgaacaatgagaacacatggacacaggaaggggaacatcacacaccggagactgttgtgggtgggggaaggggggagggatagcattaggagatatatctaatgctaaatgacgagttaatgggtgcagcacaccaacatggcacatgtatacatatgtaacaaacctgcacgttgtgcacatgtaccctaaaacttaaagtataataataataaaataaaattaaaaaataaaatgtcttatatccaaaagacaggcaataacaaatgctggccaagatgtgaggaaaagggaaccctcgtacactatcgattggaatataaaatagtacaatcactatggagaacagttttagtttcctcaaaaaactaaaaatagagctactatgtgatccagctgggtatatacccaaagaaaggaaattagtatatcaaggagatatctgtaccccccgtttgttgcagcactgttcacaatagctaagatttggaagcaacctaagtgttcatcaacagatgaatggataaagaaaatgtggtacatatatgcaatagtaccattcagccataaaaaagaatgagattctgtcatttgcaactacgtggatgaaactggagatcattatgctaagtaaaataagccaggcacagaaagacaaatatcacatgttcttacttatttgggggatctaaaaatcaaaacaattgaaatcaggaacatagagagtaggaggatggtctgaggctgcaaagtagtggggtgggagagggagatggggatggttaatgggtaccaaaaattagaaagaataagacccaccatttgatagcacaacagggtgactatagtcaacaataattgtacatttaaaaataactaaaagagtgtaattgaattatttgcaacacaaaggataaatgcttgaggagaaggacaccctattctccatgacgtgactagttcacattgcatgcctgtatcaaaacatctcatgtactccatgatatatacacctagcatgcacctccaaaaagtaaaaataaaaataagtaaaaatttaaaaatcattaattaaaaaagaaatataagaaataatggagaaggagagagtagaacatgtgatcacatatatggaaaaagaagatggaacatttcttagtttctattttgggaaattacatgacatgcatagactggttttgcccaaaagatgaaactaatccctaaaaaatatgactcatggccaggcatgatggctcatgcctgtaatcccagcattttggcaggctgaggtgggtggattacctgaggtcaggagtttgagaccagggtggtaaaccccatctctactacaaatacaaaaattagctaggtgtggtggtggttgcctgtaatcccagctacctgggaggttgaggcaagagaatcacttgaacttgggagacagagattgcagtgagccaagactgtgccactgcactccagcctgggcaatagagagatactctgtctcaaaaaaaaaaaaaaaaatgactcatgcctaaaagataccttgctgagatattatgacagtagagaattttagtttgcatgatatctcagcaagatggctttctctcactaagacattacttaagatatataggtagtgttcagagtctggaagatgcaaactattgagatgaaactttttctatgtagattggtgtgagaaaggaatcttatagcttccccaatgtctttcaagccatttcttctacagaaggggagtaacagatgaagtggtagatggcggccagggctatgagaagataaagaatggcaaaaagaagaatttttggatttaattgcagatatcttggcatctttgctaacattggagattttcttttgcttgtctattgaaggtgcttaactcatatcaatcagtttattgacccataaggagtgcatttttgctcattataagggtccttaagcacaaaaagtgagagtaagaggatggtatgcaagatcccctgtttcacaggctacaaaggaatggaactattcagattagtgatataataattgacactgaagatgccttgactttgactctttcatttttcatgatcaccctgctttagtttctctcttagcttttaattttattccaaaggcctcaatttagatcttattagttagttgagctaataactacctatacaaaataaataatttatgtacatgggaaaaataactttagatggttcaaatgactatgcaaaatatctctgacttttggctaccacatggccaggttacaaattttccaaacttttttggcctgctttccttttacatataagttccaatttcagatcctttctttgctcacagatataagcataggctgttacaagcagccaggccacatcttaaacactttgctgcttagaaatctcttctgccagataccctaaatcatcactctcaagttcaaagttccacatatccctagggcagagacacaatgtggccaagctctttgctaaagcaaaacaaaagtgacctttgctccagttctcaataagttcttcacttccatctgacatctcatctgcctggactttgcagtccatgtaactatcagcattttggtcacaaccattagacaagtatctaggaagttccaaactttcccccatcttcctgtcttcttctgacccctccaaactgttccaacctccaactgttacacagttccaaagtcgcttccacatttttggttatcctttcagcaacacctcactcctggtaccaatttactgtattagtctgttttcatgctgctgataaagacatacccaagactgggaaatttacaaaagaaagaggtttaattggacttacagttccatgtggctggaaaagcctcacaatcatggcagaaggcaaggaagggcaagttatgtcttacatggacggcagcacgcaaagagaacttgtgcaggaaaacttccccttataatagccatcagatctcttgagacttactatcatgagaacagcatgggaaagacttgcccccataattcaattactttccactgggccctcccacaacatgtgagaattcaagatgagattttggtggggacacaaccaaaccatatcaacttctttacttactaatatgcatttaaggtttctaagtgcttttcatgtcttgatagctcatttctttttagtagtgaataatattccattgtctggatataccatattttatttatccatttacctcctgaagggcatcttggttggttctaagttttggcaattattaatatagctggtataaatatctctttgcaggttttggtgtagacataagttttaactacttttggtaattaccaaggagcacaactgctggactgtatggcaatggtatgtttagttttgtaagaagctgccaaactgtctcttaaaatggctgtaccattttgcattctcaccagtaataaatgagatttcctgttgttccacatgctcatcagcatttgatgttgttggaggtctggaacttgggcattggaatagaagtgtcagggtatctcattgttttaatttacgttttcccaatggcatatgataaaaagcatcttttcatatgttcatttgtcatttgtgtatcttccttggtgaagtgtctgtcaaggtctttggcccattttttaatcaggtcgtttgttttcttattattgaattttaagtcttcttgtatattttggataacaattctttttttttttttttttttgcaaatactttctcccactctctggtttttcttctcattttcttgacattgttttttacaaggtagaaatttaaatttttatgaagctcagtttattattgatttctttcatggaccatgcatattgtgttgcatttaatgactcattcccatgctgaaagtcatctaggttttcttctatattatcttttggagttttacagttttgcattttacatttaggtttataatacattttgagttaatttttgaagactgtaatgtctgtgtctatattcattttcatatgtatatatattttttgcctgtggatatccagttgttcctgcatcatttgttaaaaagactatctttgccccactgtattccctttgtttctttatcaaaaatcagttgactttgtgtatgcaggtatatttataggttctctattctgttccattgatctatttgtctcttctttcataaatgacacactttcttaattaatgtagctttatgttaggctttgaaattaggtaatgtcagtcctttgatttgttcatgtctttcagaattgtgtttgttattctggttttttgcctttccatatatgctgtaaaaagaattcatcagagtccctccaaaaatcttgctggacttttgattgttattacaccgaacctgtagatcaagctgggaaggataaacattttgactatattgagtcttcttatttatgaacatggaattcttcatttctgtagttgtcctttgatttctttcatcagagttttatagttttctttatgtagatcttgtaaatattttgctagatttatacctacatattttaccttttgggtgccaatgtaattgttttctgtttttagctcaaattccacttgtttattgctggtatataagaaaatgaatatgtatataatgtatataataataaataattacttatatacaatatatcatattttatatgttaaccttgcatcctgcaacgttgatactattgcttactagttccaggagttttctttttgtcaattcttttggatttttttatgttgatgatcatgtcatctgggaagaaagttttattttttcctgcccaatctgtatagcttttcttttcttgtcttgtcttattgcagtagctaggactcctgatatgatgctgaaaaggagtagagagaagggacatccctttcctgatcttagtgagaaaacttcagttttctcattatcaggtatgatgttagctgtaggttttggtagacactgtttactgtattgagaaagttcttctctattcttgttttactgagttttttttttgttatgattaggtgttgaattttcctaaatgctttttctgcatcattgataagatcatgtgatttttcctctttagcctgttaatgtgatgaattacattaaatgactttcaaatctgaaccagtcttgctatttgttgcccttgttctttgttcttattctgtcttccactctttttttttttttaataattccttttctggtttttttaaggattttttttttaatctatgattttcttttttcttttattttggtggtggtggaggtggggacacagtctcactgtgcccaggctggagtatagtgatgtgatcttggctaactacagcctcaacctcttgggctcaagtgatcctcctgcctcagtctccagagtagctgggaccacaggcatgcaccaccacgtccagctaatttttgtattttttttttttttttttgtagagatggggttttgccaagttgccctggctggtctccaaatcctgagctcaagtgattcacccaccctggcctcctgaagtgctggaattacaggcatgaaccactgtgcccagcctatctatgattttctataatttgaataggaaatatttaggtattttgttttgttttggtatatatcttgctgtgtgttctctgagcttcctggatctgtggtttggtgtctgacattatctggggggtaattctcagtcattgtctaaaaaaaatcttttttgattaatttctctctttcttctctatctgatattccccgtatgtatatgtgatactttttgcaactgccctacagtttttagatttttttccattttttcttttgtctttgttttctttgcttttcagttttagatgtttctactgatctgtccttaatctcagaaattctttccttggctgtgtcccgtctactaataagctgatcaatgatattcttcatttctgtgacagtattttgatctctagaaattttttgttctttcttaggatttccatctctgttacattgcccatctgttctggcatgctgtctactttattattagagctcttagcatatttgttttaaattcctggtctgataattccaacacccccgatgtgtttctctgatgcttgctctgtctcttcagattgtttttgccttttaatatgccctgtaatttttttcttgatagccagacatgatgtactgggtaaaaggaactgctgtaaatatgctgttagtgctgtggtggtaaggtgtgtggggaggggaagtgttctataggcctacaatttgttctcagtctttgagtgagcctctgggctgtaaacttctccagtgtttcttagtctccctcactcctcacacaccctttagctgggaaagaactcaagggtgggctgaagttgggtatttctcttccaccaggtcagttaacctctgataaaaccccaacaggttaggctttggttaactggtttctcctgagggcagaactttgttaaggacagagtgctgcagtgtatttcagaattattccttttcctctatccatgctggaagtgcaaggggatttttctgtgatatttactgtggaagcctggtcaagttgctgaagataaaacttataaaagtgtggccccagcctccccaccccatgactcagccttcctggagtttttgactctcagacttgtcctttctgagcctaaaacagttttcaaaatacagttgaggttttcctacctcagcaatggttcccataaatgcttctgcttctgagtctttgttccagtaagccacgactccctgcattcacctaattgtccaatcctgggggcagtggtatgcccgatgtcctcacctttattatggatccaagatgaattgttgaattttcagtctgttctgctttttacttattaggagtgagtggcaactttaaagctccttacatgcagaaccagaaactagaaatcatctgttattgtctttttaatataaattttgaagaacattctctatattaagaaaacttgtcatataaccatcatataatgtatacctatatcttcttaaaaagtgtattatcattttgactttacttatgatcttgtttgtcatgcagaatttaaaaaatactatatagtcaaatttatcaaaacttttttcatggactgtgagttataagccctgcttaaaaatccataccactccaaaatggtaaaattttatactgtattttctttagtttttcagacttttttgtatttaaatttttaataagagtgtgtatgtaaaaaatgaggttgatgtccagggatttttatttttcttatttttttggttcattttgaggctgccactcatgctcaacatccttttctgaataactcatttttcttcattgatttaaaatgttatatttgtccattttccacgtttcttatttttcgctattaaggttttcaacttaagcattaaaaaaatccaaaatggattgtttattgttaatggtgcataataccaatagcttactgaatatgagagtaatatgcagccagtcatcactgagctcatgctagaaataagtatgggattatgatgtgaatagaaggaatgttactagaaatggagaaagagataaactgtgagagtgtgtagtgaggtgtcacctaaggcaatgtaaactatatgcctgtaatctcaaacttgtcagttgtttccagttgagaggactcagacaaagcagtagaaaatcatgctcataaattgttcactgagtaagaagtagacaaccagctttggaaaacaatgacaacttggtatcttctttgttcttcttgaagaggagaaattaaatagtcaacacttggttttagagttctgacaagttccaactagttgaaatgccttggaatttgcagctacttcaagtttgggatgctgtcattgttctggaagaagatttttgaattttttctgttaccacatatgctccttgatgatgtttagttatatccactgtggaaactatcatagctctctgagaatgttgttgaaaattgattatatttcaaatatagtgcccctaatttaagccgaatgagtatggacaggtcttttttgctgagatttcttcttcctgcctctccctctccttcaccctcttgttcctctctctgtcctctgtcctcttttctttctcttccttgactttgctggactgattccatgatcctttcctgaagtaagcatctctgggggatcaacccttactttggactacaatgccattgccatcaatatttaaaagtaatctcaccataagataccatctcacaccagatagaatggtgattattaaaaagtcaggaaacaaccgatgccattgaggatgtggagaaataggaatgcttttacactgttggtgggagtgtaaattatttcaatcatcgtggaagatggtgtggcgattcctcaaagatctagaaccagaaataccatttgacccagtaaccccattactggatatatacccaaaggattagaaatcattctactataaagacacacaaacatatgtttattgcagcactatttacaatcgcaaagactgggaaccaacccaaatgcccatcaatgatagactggataaagaaaatgtggcacatgtacaccatggaatactatgcagccataaaaaagaatgagttcatgtcctttgcagggacatggatgaagctggaagctatcattctcagcaaactaacataggaatagaaaatgaaaaaccagccagtcacagtggctcatgcctataatcccagcactttgggaggccaaggtgggtggatcacctgaggtcaggagttcaagaccagcctggccaacatggtgaaaccccatctctactaaaaatacaaaaaattagctgggcgtggtggtgggtgcctgtaatcctggttacttgggaggctgaggtaggagaatcacttgaacctgggaggtggaggttgcagtgagccgaggtcatgccattgcactccagcctgggcagcaagagcaaaactctgtttaaaaaaagaaaaaaagaaaagaaaactgaacaccgcattttctcattcacaagtgggaggtaaaaaatgagaacacatgaacacagggagggaacatcacacaccggagccagtcgggggttagggggagagcagagggagagcattaggacaaatacctaatgcatgtggggcttaaaacctggatgatgggttgataagtacggcaaaccaccatggcacatgtatacctatgtaacaaacctgcacgttctgcacaagtatcccagaacttaaaaaaaaaaaaagtaatctcattgtaaaggaaagcagctgttcacaagagcatataaaactaacaatggatctatattatttaggttcacgcagatttaagactgtgatgtctacatgcaactctctgtatatatctatctgtattgatagagatatgtacatatctatatctgtatctatctatctatatagagagatttattttaaggaatagtttcacacaattttaggggctgggaagtccaacttctgcagggcaggtcgtcaggctgggcaacctgggaatcactgattttgcagtttgagtttgaagacaagtctggaggcataatttcttcttctttggagagcctaagtgtttttcccttaagaccttcaactgattgaatgaggtccattcacattatgcagaaaatctgcattactcaaagtctactgattcaaatattaatctcatctaaaaacaccttcacagtgacatctagactgatgttggaccaaatatctgggtactggggcctatctcagtggatgcataaaattagccatcacacggtctttacctctagcaaatcttttccaaaagcctactttgcttatacaactataatataccaactttctttttattgtttcttgtataactatttccattctttcaacttctctgagctttaaatttcaaacttaaaataaatcctcatatatctacactctcaactgttcataagcttcttatttcactgagaaaatagaaacaatcagaagagaattttcaaaaacttcaacacttaccagtcacttgcatctatgctcaaatactctgtctttcctctcattagaatgtcatcccctgtgtgcagggactttgcttattctcagcacttatcatcatacctgaaaatgtaggcatttgaaaaataattgttgaattaaaaatgaataataaaaataactctgtcattaccagaacaaaactatcatttattcattccctcaataaaaatttattatatgcctatttattgacaggccttattctagcaactgacaatgtagcagagaatagaacagataaaagtccctatcctaagggagcttatatttcagttgaaggctaagttcatgttagccactacaataagcctttacatgaatcatctcttcaatctttcaaaaattgttaggtaagtgttatcatacctattttcagatgagaaagctaaggctcaactctcctatttaatatcacatagagccagaatgcagagcttcaaatatatgtctaaattactaatctactgtgctgatatagacatgaagggctttatcctctatatcatgctgcaaataggaggaaaaaagcttgatcaaaagttctaagcaattgtagctctgaccccaagagggcagtatttgcattcgccccgcctgcaggtctgaatgtgtagtatgtgtaacatagcgaagcctggtctctgattggctagggataccctctgagaaaccctttggttagtgttaaaaaaaaagagaagatgttgaatacacaagtcaacttctgggagcagatctctgcagaataaaaatgaaaaagcatctgacgaccttcttggtgattttgtggctttatttttatagtaagttagtggagagttttagcaaagttaacatagtaagtcaagggaatattttcttaggatttggggtgaagatgtagtccactgggataggaggaagggagaaaatgggaccattttctgtttcacttgggattcattgtggggagtaaggaagggatgcaaattagacagtattaatactggatgatggatctcttgaatctcacttttctttctgaataggggggaatggcaaaaaccaagtggagcagagtcctcagtccctgatcatcctggagggaaagaactgcactcttcaatgcaattatacagtgagccccttcagcaacttaaggtggtataagcaagatacggggagaggtcctgtttccctgacaatcatgactttcagtgagaacacaaagtcgaacggaagatatacagcaactctggatgcagacacaaagcaaagctctctgcacatcacagcctcccagctcagcgattcagcctcctacatctgtgtggtgagcgcactgtgctccacaggcacttgaagccagtatgcaaacctgcacctggaggttatcaaggaggcataggagttagagtagaccgttattttttatgcagaatatgatttcactagtgaatatttatctctccgacatgatttgatttgagcttgagcctaaagttctacttaggctcaagtagaatacatgtcctcaagcgaggataaagacattctcactcaacacacaaagttaattgctacatctgggtgttcccaagggcaagacagtctgtcatgctgtgttactattgctgaagtagatgacagtgttgtttggaagggagagactagcttggtttttgatctggacacctaccagcagaatgtcaactaagtgaaagagcaacaagtttatgtggctgatggaaatttttttttttttttttttttttttttgagatggagtctcactcagtcgcccaggctggagtgcagtggcgtgatttcggctcactgcaagctccacctcccgggttcatgccattctcctgcttcagcctcctgagtagctgggactacaggcgcccaccaccacgcccggctaatttttttgtatttttagtagagatggggtttcaccgtgttagccaggatggtctcgatctcctgacctcgtgatccacccatcttggcctcccaaagtgctgggattacaggcgtgagccactgctcctggccggaaatatcttgagaagtttccttcccctgaaagacattcagttgtcatttcatggctattcaagttctcagaaagcatcctgtgagaataaatctgctcttcccatttagctatgctccagatcaaggcttttgtccaggtgctgcatcaactctttattatcttccatcactgctcctttagaggacactggaaggccaggggatcctggcagacacagtcactctcaggcagcagaacaactgtgccaggcttttcaaccatcagtgttctagaaaagagacttagggacagaatgcctacctgcaattgtgaactctggttttcacaacttagctgtgaagttctttttgggacaattagagaaatgtacatataatttgagaattagatgagaaaagtacttatttaaaaggcagatatcaactgtaaaaaaatgggaagaatatatactaagatattaaaaatggtaatccttgtattgtgggaatataatgtttttactttttatctttccttgtcttctgtacttttaattttctatagttctcggatttttcttctgtcaaaataaagattattaaaaaataacaaatgtcttaaaaaatttaaaggaatgcatctcatctgtcactatcaactcacaggaattgatatttaaagatgatcacacatttcaggatattgttgaataagattgatttgttatgcttatgagcactgcaagtaagttcatttccaagttcagtgaattgataatttgtgaataaatgaagccaggacctggactgttctttgtaactagtctggagatagctcaagtgtcaagacatcaaaatgccttgacttctggagcaaaaagtaaacctagatatattcagtaatcagatattttttcctgtcctgtatctcctttcaagtctttagagtgaagaaattaaagttcagattgctgctacagcagacttgtgtgagtaatcataaactaattgaggaaaaagataaaatacatgaaaatggaatcaataggtaaaattccaagtacgtggacaaataagttttaaaggtattctcaggaggagattactgtgggacagaaaagataggagaaagtatcatggggaatagcaaatttagttaggtcttgaaggagagacacacattgaatttgttcattacacaattatttattaaacaaataatgaggccaggtgccgtggctcatgcttgtaatcccagcactttgggaggccaaggtgggcgaatcacttgaagtcaggcattcgagaccagcctggccaacatgaagaaaccctgtctctactaaaaatacaaaaattagccaggcatggtggcatgcacctgtaatcccagctactagggaggctgaggcaggagaatatcttgaacccaggaggcggaggttgcagtgagctgtgattgcacatctgcactccagcctgggcgatggaatgagagtctgtctcaaacaaaacaaaacgaaataaaaaacaaataataagtgacaggtgtttttgtaggtagaaggagtagggtaataaacaaaatagataaatgcagacacaaaagaccttccattacgaggcttgagtctatgtttgtctattgcgttcactttcttttacaggaatatcttgggaagtttgcattccaatataggcatttccttgcttgctttagtttagtttagtttgcaggtttcatatggtgagtaaaaggcacaggcattgaaatgctctatctatcacttactaaattgcattactctggacaaaattacataacttcagagcacctacgcgccatcaatggtaattacacgtacatcacatggtcataaggattgaattaagttaagtgaatttaattaaatgattgaattgcattggtagaaaataatttttcaactaatggtagttattcttggacataaatgataaaacaaaggtaatttaaaataagacaataagaaactttaagtatagattaaggtttgcctttccactcttcttctgttgattatattcttttactacagttatggccgagagtcaccctttatttcacattggccttattccattcaattatttgaactgacagtattggctttcttgtttgtttgtttgtttgtttgtttttatctcataggttttctgcacagaaaatgaagctttcttgcttccggtgtaatttaatgtaaattctatgatgaatccacatgagctttatggagcaggactccgatataacaccattatactgacctacagtgccaataactagatccatacccaggagctcatttaacagagctctgcattggaaaggagagaaagtaacctttctaggtttgggggagaaatcctttttagttattcaatttataacttgtacatacatggtagatgcccaggaagtattacagaagaaaaaaggaaagagaaaaatctaagggacaaatgctagatgcagctgactgagaatcagcacctggttctgccagggtccttttccatgctacctcttcagagatcaggaggagctgtgtgatctgtgcaccggggagtaaatcttgtttctggctggttggggagactttcagcttcctgcaacaaagaactatgaatgttaactcagagaaaccagagatttggcttgatagtgtttgagggctcccagaccccagccagagacctcactgagtctaagtgataaaaacggagaagcccttgggagtttcattcttgatttcctcctggcagctgtgctgtgagttgctgggctctggaaatatcataaaaaagagcagattgtagtttcttctttataagtctggaagttatagaagggtggttagggtctcagtgctcacctgtgggggctgtgaaaagagagtatatcttccaaatgaatgaatttccgtgaatgaatgtcctctgtctgtggttctctgtttaaacaggggtgaatagactacatacactggagcagagtccttcattcctgaatattcaggagggaatgcatgccgttcttaattgtacttatcaggagagaacactcttcaatttccactggttccggcaggatccggggagaagacttgtgtctttgaccttaattcaatcaagccagaaggagcagggagacaaatattttaaagaactgcttggaaaagaaaaattttatagtgtttggaatatcgcagcctctcatctgggagattcagccacctacttctgtgctttgcagtagtgtctccccagcacctgcagcctgtaccataacctgcagccgggacccttgacacaggctagccttgcaggtgggagtgaagatttttttttttttttgtatagagggaactttctttatgacccgcatctccaaaatagaagtgaaggataatgtatctttcttatgtaatgaaactgaatttatattaaattaaatttccttttgttattatttaaatttcattccttgatgcagtttgtacagattctgagcctgtttgcccacagattccttccactgctttactctttaagaggaaagacccctttgtggtgcaggctctgagtccatgaagcaagttttctccaggctataccctcatcaggaacattttacccatttgatcatatcttcatgatgtttttgtaccatctataccattatttacttaatttaatattaaattgatgtttatgttaaatagactttaaaaataactgtaaaattgtcttcattttaccagataccatctgtgaaaccatgtatatgatataaataatatatttaaagtgctgcttatatttttcccaatataaattaaaatagcatcatatatgtaacaattgaaaaggctgtctgtatactgcctaataggacctcttgtatcaatcacactttaagaaatactgatccagcccatacccctcatttcataaatgaaagaattgagatccacaagtatggtatcatttactcaagcacgacttacagtaaaatgaaagctataaaaagagtctaggctttatgatcccttgtcagttgcttcttccaccaatgatgcaaagcaggatctaaagtttgaagaaaagagttgcgtgttttacatttaaattaaattaaaagttttatttaattgtgtatgttcaacctaggtaaattagaagatacgactacctatcaaagtagagcattctcataacttcatcgcctagaaataacaagtatttatttttcaaattttcttgtatacatatacaactacatttctctatgaatggggctgataatgtccccagtatttattaatgtgcttgcttctctcaacattatagatatttccatgccagggatcttatattgaggatataattttaaatgactgtctagttttcattatatattttttaaaaagtgaatcaccttttgataatatttctaattatccagtattatagacaatgtttttattaacatcattcaagtcacagctttcacagaatggagttgggtgaataagggaaaacacataacactgcatatctaattttcaggaagaaatttttcaccaaattgtgattccaacaatagcatgtaatgctttttgttttccatactttctttacctgttatgaacattattacttgaaagaagtttccactttgccaagtaaaatttttaaatgttttgactcttttactctatgaagttatacatttgttattaaaaataaatgaaacaggattagaaaacatacagagtaagagtgtttcacacaacataagtatcttcatacaataagatatgttaaagaagaactttgaaaaacactctcatggtcccatttaccttccaatgttctctttcctttcaaggctatctattctccacgtcgttcctactgtaagtgtggaccagcactatctgaacttgtgcggaatctcaggctgactgaatttgaatctgcattttaacagaccaaccgtgtcattctatccttcaaagtttgagaagcacccctttcatggggtgccagaatgattttttacaatataaagtaaaagctgtctctactagcccaaaaatgcttcaatggctttctattgcttctagaataaaaatgcaaatttcaggctgtgctacacaaagatatgtatcatgtgaacctccttttcaatctccccttttaactctcctagctctctatgtagcaataacactattctcctttcagtattctgaacttgccatgttcttttccacatttagtcaaactcgtccatttgaaatgctcttcctccaaatatgggcaagcccaattcattttcacatttcagatctcagctcaagtacacactatatagataaagacttctgacttctgttgatcttcgtgactaacgtagccatccatggctctccccacagctttatcacaaaaccctagttatttcccttatggtaataatcataacatctagttataatgttgatttacatgccaatgtgttcattgcctaaacttccaattaggatacaacttctatgaggtcagggatattgtttgtttaatcacacctttaactttagtgcctacctttagtgactgccccataatagtcagtgaaaaaatatcttctgcatgtggctgggcgtggtggctcatgtttgtaattccagtactttgggaggccgaggtggaaggatcagttgaggtcaggagttaaggaccagcctaggcaacatagtgagaccctcatctctacaaaaaacaaaaataaaatattaaatgagtgtggtggcatgcgcctgcagtcctagctactcaagacgttcagacagaaggatatcttgagcccaagagttggaggctgcagtgagctatgatggtgccactgcacttcagctctgggtgacaaagcaagacctcatctcttaaaaaataaaataaaataaaataaaaaagaactatatacagaatgaataaatgaatgttgcttggccttgcgttcttttttcctttcgctttcttctcactcccatcctagcaaatctgaacttcgtgtatgtgctccctgctcagatatctggtagagttctttaatgctggcacttaccccttgtctccggaccaggccttcctatgctcagtgaactctgtcaaataactagatcaactcagggtctcaatctgtcctcactcaattgacatcaggtgtaatctgaatgaaccgagcaaactctaaacataatcccacagtaaaacatctgaaagaaaaaaaaggtatacttaaaagatgttggaaagtatgaaatcaacttcccaaatcaaataaatgataagcacatgtcaaagtttaatctcaaattattgcaagagaaaaattgcatcaggaaacacattcaaataattggactaagtagagacattttatagaaactaggtttttttttaaagtcaatttaaagataattattatggtcaaattattattggttcataatgactgtactctgtgtagtggttgttagactcatcatgagattaatagtcatctgagattataacactaatatctcagaatgagtctttattttagtaaagaatatcagaaaattgatcaaatatttgatcaggtatgatagttaattcccatatggggctatacattttatccttcaaaaaagtttcattcaagaccagttttgggaaatttattgttgtcaaaagtaattcaaaccaagtgtggtgatgtgtgcctgcagtcccaggtactcaggaagctgaggtgggaggatcccttgagcccgggagttcaagtccaacctgggcaatatagtgaaacctcttctgtcttaaaaaaaaaaaaaaaggtaattcaagtctttagtctttactataatggagaggagggatttgtcaggttttggatgttttcccttcctacaagttactaatcttgtttgattgaggctacagtaaatatatgaaactacttagagacaaaggattttgttactcatgacacagcaaacagcataaacattgttatattcacttcagtcgttctttcccttaaatctaaaaaagatgatatgtatgctgacgaatactttgtttgaagtggtactgtgtcataactgaggaactttgagctcggagaattcactgcttttatagtaaggagtaaaccaaattgctctttgtctcagagggaaacagtacctcacccctcaaggtttcttgctgcaagcataactctggaaattggtcaggtagagtggtcatggtcgtaaaccactggcatacctagcaagacatttatgagtataagagattaaggatggtctggttttcaacaatatccactccatattcttacattgtgttattttctagaaacttttctcatgagtgtgccactccagaagccgttctgatcaatttgacagacagagattccgagactaaatacattgaatttgcctcaaacaatgtttaaataaggctactatcagcagaccaatctgcaacattaacttcacccatttagtcagctgtgacaaagtcccaaagtatagataactaggatataatttcttatccattatacatggaagtttagattgatacgctaatctttgttttaattctcaaaaagagtccaaaaagtagccaccattcctaatggaaagatgttctgtcccacctattcccagacataagcataacccaacaggttaatccagtttggaatttattgttaaacttgatttggatcagcattacatcacttttgttgtaggatccttggggtgttgcttttctgaccagaaacctctgtggttggtggtgcctttactcaagttttgcatgggccccctggactcattccacttacttggcctggaagactatgctcagctcatgctaccggcctggatcttatgcttgccaagggcgagtcaggcatggagcagtaagggatgtgtgaggaagtgtggggtcttgccactgcacagtcagacatgctggctgctgcagtgaggtgggcagtgctggcatgggtgccagctgtctacaagactgaggctagaccagttgcactgcaagcagcattgactgctggcactggggaacacggtggcactcaaaagcttggagatgccaggaaccatagggtcccaaagaggggggtcatagccctgacttggggagctctcaggtctgggcttcccacagggccacagcacttctctccttttttttacccacaatgtggcaaacacgggacatgtttcagccctgtttgtggaacagctcttttagccccaccatttgatgggttccaagttcttgtcctgcaaccaggaagaatgaggtacacagtcaagtggagggtgagcaagatgaagtagagctttattaagtgatagaacagctcagaggagacctgcattgggtagcttctttccacagctagggtgttccaatgagtgttcagctcgtagcagagaggagaccctggagtgggaaactcctctctgcaggcaggctgtcctgttgtctctgtagctctcagcacagaggaggccctggggtgggtagctcctctctgcagctggttgtcccagtgtctgcagctctcaatagagaggaaggcttgtagtggttagctcctttctgctgctggtcatcctgaggtctgctcagctctggctgagcctggggcttttatgggcctcagaagggaggaagtgcatgcccaatttatccatgggcagccatgggcaggcccagaaaaggcaccacaagttcccattccagtctgtgggactggcagcctgacacccagccttcaggccctccttggcctgaaggtgtgacctcactggggacccaccacttccacccagaaacctgtctgcctcctactgtcattcttagtgcccagatggtaggtgccaaggagtgccttcaggccagtgcccccttggcttccctcttatgcttgtcagtgcccaaaatctggagggtgtcaaggtggcagagggctggtgtgtgaacacttcccctagtgtgtgcacactctactgtgctgcaacagtgcctgggcttggcctcaactttgctctgagatcagagtggatgctgacaacaaggagaagccaggcagtgagagtgggtacttctgagcctgtgaaggcagggagggcttcccaggccctcaagagtacagagaagcctcggtccacagctgcagtttgggaagctgtagctgcccacagagggaggttgagggggcaatgctcctgcctgccccatggagcagaagtcctgggtttgcagccttgacttgggtggctgcagcttcactgagaagggtggggctcctgcctgctcctggtttccccaagagcatagggaggcctaggtctgcagtcacgacttgggaagctgcagctgtgcctggaagggcagggttccctcctgctcctgggcagagaagacagtgatgcccctgaagctgtggcttgggcagctgcagggcacctggggagctcctgctccaactcagaaggggcagggctcctgcttgtccctggttccatggagtatgcagccccagccatgcctccctgctgtgatagtagtggccactccagatggcccgctgctgccatcacttttgttaagctatatgagcagtgccattgagtatttgcaacctctgtagccattcatggcataacccaagacttttcagacatcaggagaagcatatacatttgtatgagtcagattgagacaaagttgtactgatttctatgtttgtacacagacaaggatgaagaatctatgttgggaagctgctattgatgtatgtattgcagaaattttcaggacaggccatattcacaggagttttactatttcaaggaatgtggaagaagatgacaaaccaagagcagattggatagccagctgcagctgccgcttggctccagcagaccatataattgtcttgctaggctgtggtgcttgacctagaatacaaagagtgaattaattctccgctcctccacctcccggtctaagattttcccttcctaggtgccagtgttattgctctttgtccaccatcacaaaatcggttcatcccattctagtagctataactttgccttttttttgtagtcagttcctagtcacaccaaaatcatttgcctagaacaaatagaaagaggaacaggcatttgtatgacatttacagagattcatcataattaccaccttggccttcctggaaaactgaacgggaacttgtaaagctgtgcactcaaataaatgctggttatcctcatgatgtaaaatcatgtttaaccaagaaaagaatataggtggctgaactggaattcaatattaataccattctgacaatgttgctgcctggagagtgtaccaaccaggctgttctaaggtcgctgttcggagaaagaaagaagcatcatgcctttcacttctagaatgttagaggaggtgtacttttttctattactgttagatacagctaaaaattctggacattatagatgttccttgaattgaaatgagattacttcccagtaaactgattgtagtttaaaataccataggtataaaatgcatttaatacatcttatatactggacatcataagatttcctatcctatgttaatcatgctcagaacacttacattagcctatggttgggcaaaatcatctaacacaaagcctattttataacaaagtgttgagtatctcatctagtttattgaataaagtacccaaagagaataatagaaaggttgtattggtacacaaagtgcagtttgttctgattgggtattgcttttgcaccatgaaaaaaatcataagtcaagtcatcattaagttagggaccatttgtatataaaatcaaaagataaaaagtttctaaaagatagagagaaaaagccagattgtctaagaaatttaggacctgaacaatgctagaacagtgagtttcatgagtttccttttgcctcatacaaaccagtggcatccaggagtagccagtaacctggtaatgccggtgggtacagaaaagaaatcccaaagaaatgccgttttctgtagccaaaggaccagggaaaggattgactatgaaggcagaaactataagaccataaccattctactctagccaaagaccacaaaaagttttatagcaaccaagcatacatttaatcaacaaaaagttaactgcaacgtagcaggagagatttgtgatagtgtaactttcttttgctccatctttccatcactggcttgaaaatagtctttaaatggcatccggcattcccagtgtgggtgtctggggctggaggaagcagagtagacccgttatcaaagaatagtgcctgactatgttgacctgtcaggtggttttctgaagggctaattcaaagggctttcctgtattcatataactcaaaaccctctcagagtggagaagaagtggctatgcagaggaaattttaaaaaaaaattgataaagggactcagtagcaggaaggagaaagaatctgcaaatgtgaagataggccaattgaaattattcagtctaagaagcggaagggaaaaaaattgaagagagcttaatagacctgcgggacattataaaaagtacagccataaggataacaggatttccagagtgagaggaaaggaaaaagcagggagaatatttgtaaaaatcatgactccaagcttcccaaatttgttggaagacatgaacctatacatccaagaagttcaacaaagaccaagtagaaaaaaggcaaaaaaaaaaaaatctcattgggacacattataatcaaactgtttaaagaaaaagacaaatggagaatcttgaaagctgcaagagataagtgattaatcacatggaagagatcttccaaagattagcagtctattgtttatcagaaaccatagaagccagaaggcagtgggatggcatatttaaagtgtttaaagaaaaaaaaatgtcaaccaactattttgtatcaggcaaaactattgttctaaaacaaaggagaaattaagacagttccagataaacaaaaactcagagtattcatcacttgcagatttgccctacaagaaaatctaaagggaatctttcaggcagaaaagaaatggcactagacagcaacttggagccatgcaaaaataatgaacaatggtaaaggtagttacatagataagaataaagccaatatttttgtagtttttgtttgtaactcccattttttccctaacttatttaacaaactaatacataaacaataattataattatattgtggaaaattatacagaataatctcattgtgtataatgagaacacaatgagtcaaagtgtgtttttccatgtgtataaaaatttcctttgtcgccgttgtaatttttaacagcacaacttatgtatttcaaatagacacaaaattagtagcatttacagtagtatcttaagataaattgcctttgaatgagatcttgctttcaatactttgatgtccacaaggcatatctagaaaattttatgctttggaagatgaagactgcttaatccaacggggaaggggactatgatttctctttgactagttgccataacactgtccttaaggcatatgaaggacttttatatgttatttagacatcagtaggcacagaagctttgcagtacaactttgacatataaattctgtcattttttttttactttaaaataaattttttttttaaatgtcactttgctagcattgataacgctcttaggtccaccacaacattatatctattcacccatactatttttgttacaaatgttaaaaaggtgatttcttcctgaaaggactgtgcttcaggtccccattcaattttagatgttatatttgttttttataaattttccaagaatgtagtggctgcattcttgggttgctgtcactcttcctttggtttttacacttactgagaagtggctgttgtaatttctgtcatgtgcaatgtattcctggaaaaagggatttcaatatcagcatgttattcttcattctatttcctatgcagttgttggtgggaatgggaagggcctgcccaggccatcattgatgtatactgattacaaggctcttgagtagaaaagagcctgcatcattgctggcctacagccaccagcttcttcaaggacacagagcagattatggactagaggaggaacagtggttgttgtgcttgttactctgtagacccagttaagtttcttgcatagttaaccctccatagatctggtttgctttttaggttaggatgaaaaggcaaagagaaagaccaaattcataaattttggagatttattcctagatataaacttaaaacaagaaaagaaataagaggaattagacaaatgaacagacatataaaagtctagatagtgaaggtaggtccatctcttttgcaacagcccaaacaaatactgttttgacatgacatgcacatgtcattggtgtaagacagaatgacgaattccaagctccagtccttggctttgttaaaaaatgttggccaggctgtgagctcaaatcatatttctttatctagattttaggtcattctattttgaaagaattcttttgaattataggaaatttctttaaaaattggagataacagaatgctatggggatgtatggcctgacatggagaagagctacgtaatgtgaaatgctccttaaattgcaagaatctcactcaaagttttggaatagaatgcttcatgactgattgttgtgtgcaggaaagtggctattagaaataattcctcttactcatacaagagttgccatttgatatcaaacacatgcatgcataaacatcccccacagacattgacttggagcatttgcttctcaaatttttaatttaactaatatgtcagatttttacatttacctgttcacataatacaggtctacatcttgagtacgtctttgattactatcatgattccacaagatggcagtgtgttcttagggaccctgaggaaagctctcaagtgctcgtgtgtgtgtgtgtctgtgtgtgtgtgtgtgtgcttgagagagagagaaggagagaaagagagagaatgggaagggcgataagaggaggggttagtgatataccaggggttgtgaaaataacctcttttttctaattggtaggacagattctttttacgattcctaaagtggaagaaataaagtatctctgctatgttcatttctttttggattgaaaattttaatcctcagtgaaccagggcagaaaagaatgatgatatccttgagagttttactggtgatcctgtggcttcagttaagctgtgagttgggcatctctataggaacataatgtacaatattttgagatattgtctatcctaggctgggggctagaagcctgaattttttctctaactaagagagtagaaagcctgtaaaaacatgatttgaattctggggagtaagcatttacctcccaatttgtcttctctgtctgaccactgtctttttcacaggggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacacacagtgctccccagacacctgcagtctgtacccaaacctgctgggccccaggaatgcctgatgtagagcttagactgcagggcagtaaagtcctctttgctctctagattcaagtggaaattaagagtactagtatggaggactgattgattagggaagtattattataattctgaaaataattgagaccctgaagaaaaatgaaagatacagtcttggtctggttaaaatattttccagtattctctttctactttagttttaaaatattttttatatttcttctggagagattaaaaaaataaatttttttgagatcattgacaaaccagaaggtttacatattcatttcatacatacatcacaatctatgccataagcatatccatcatctctaaaagtttacttcctccctccttttttaaaaaatttaggtatgattgatatacagcaaggtgcctatatcacataatgtatacattttaatgctcactctagttttatgccacatctatgctttattagatcggttttatgattccttttatttatatcaagaaaacattttcatacaataacagatattctgtctctgtctgtaggacatcttattctttccccatttagttacccaagaagtttgatagacgttgctttaggaatgcaacagaaaaacacaaatgcaaaataaaaaagatcagcaaactactgtgaaaatcctgtaagtcataaattcttttagttatagaaccctcaccccatctccagccttagctgcagctccactcctgagttatataagggcacatttgatgagtagatggcagaactagagggagagggtgagaacacgttaaaaaaaagcctagatatttgcagagattgaagattagagagggtctatattgccattttggggtaaagtctgaattgaactcaaaaccttgtggaagagtatattgatttctatgtaactgagtgtggcttggagatggtagggagtcttagctctagtcacagcatgtcatatacccacagcacctgctggaatgacttaaaatttattgagaaggatctctaagtatctaaaagaagtctagacaccaagaggctttgttgtgatgaacaaagacctgtttaaatcagtgaccagagaccgtatggtattgagcatatttcagcaaatgttggaggagagttggaaacactgaagagcatataaatgcctccctcctctgactacctagcaatacatatttgccctgcaatatatactatgttcgggcaaaatatttgtgcctgatgaaaagaatactttttagtagctattaagttgaattacaggaaaaaactttgaacatcactttattataaaagtgaagttgtagtctgttggacatgatatagtttatgtagtcctcaaagtgggaaagtttagaaatggagagttaagatttctgtcaagggttgttcccatagtcactgatgaaaaggatgaactcaatccaaatttgcttcaaattcttaatctgaagaatgaaagactgaataaatctttccaagccttggaagaaagatttgaaaggcagtaaggaagagcagaaagttgcgccagaatcaagacccttaaattttacttccacatttgttttataccttttggcttcctggcattctggaaagaacctgggttgtgttttctgtttgaatatttatgttactaatggtccatttattaggctacatactatatatatttcaggatttgtttcagtattaaatgagataacatactgctttgggatgagttccttaaaagtagagactgcagttggaatctttctctgtaattgattgaggaaaccaggttgagacagggggaaaggctaagcatggacttggtccagtgggagtcttgatcccacctgacctcatagggagctctggagagtgaactacatcacaggggtgatccctcccacgctgaggcaagggagccagactgctctgacctattgtgggtaagaataaagtcataattggctgcagtgtttcttggggtagaggtatatgctactggacaatggtggctctcattggcagaggtcaactttctagggaaaggggcaaatgtgagccaagagtagccaacactcacagtagcgggggatggctacactgtcctgggaaaggagatctaggctgggggccagcagtgttcgttattaccagggaacttgcctggtatgtgggcagcattcaagaaataataaactttaatcatattctgaattttaatttcactctccttttgaaggtgtttatacagctggccttaccaattttgaggagttgaaataatgtaagttaaagcacttgttaacagaaaccatctaagtaaacataaaaagcagatgaaaggaaaaattttttcaaagctaaaattcagaaatttttaaaagagtagtgaccagagaaccagtctactatcttagttgcttttgggaatgatgagataacattctatccatcactttctatccaggtagcaatgattctgatgatttacagttcataactctgggcttctatgtgtagacagagataccatctatatttatacatgattaatgctattttgttattaatttgtatttaagaatgaaggactgggtagcaggatggactccttatgtctttgtgtccatgttccccacaaagtttcttcttgaatggggtgcctggccagtagtgtgggtatgtgggtctgtcatgtgaattgacaggcttctttctaggatgaatgaggagggaactggtaattaaggtgcttctctttgttccctgaacctaatatcattggaaatggcctaattatattaattactcataataaaaactgaaaccatcccagatggctcaagtaaactctcatgaagattacatgccccaagttggcttcatatgcttctcacacacaaatacagaagcaggttggtgagaacagagagaggctagtgcagccattccacatgtggaccttcactacgttctcttgtgttctgttcctctcacccttcatcacctgctctctttctcagcccagaacctctccagggtcccacccagtaggttcccttcactcacgtttccactgtaatcttctcacagttcattctggcctggactttttccctctctgttttctccatcagtgtatttgcatccactttttatctacctcatgggaattgtgataactttcatctttttattagttttattattgatggattcaggtcattctgtttataattttacatttcatttcagtgggaattttagagagttaagaggacagcaaatatgtttagtttgaagttttgtttcagaaccccaccctagtaacatttaaatttttaagctgactatataattttgtcttacatgtgataaaaaatttataggcagaatcaagaactagatcagaagcccaagggaaaactgatttcaggctggtacaattcaatggagtattcagaaagcagtttttgttctgaccttgtaaaatcccattttacctgagatttttctccttactgggttatttcatttttaggatccaatgatctctatgctacaatagattgggtggggaaggctttttgctcaaaagcttcattttattattggggcacagagcagtctgttcttgttcgctattgtctcccacccacatggcactgctgtttgctttgctctgttgagcgtcaccgtcaatatctctcaccatttctacacctctcacaggttcctctcatttctggtctgctgcttgcactccttccacctgtattgagttcatgtaggtttactttttaaaaatctctttaactattttgataatcacttatttatatgttatattttcttccatttatcattctgttcaagtttctttatagatggagaaacttaattgtggagatagaaaaactgcattaattttttttagtggcagattctcataatttggcacaatatatcagtctattctgaacactgacagttggaatagtactctcactttctctttttaaatataagttatctaaattattttctcctaggttcacaaatattaaacttgttgacctgaaattaggaagtcttttccacactttccacttgacaaagaaaattcttgcctttaatcgtttgctttgattaattaatgatatgtgatccaggctgactttaagtatgagtctctgatctaatttattttttaaagagtcaactaaaggaataatctctttcacccactgtaatgctcacatccagctgcacagggccatatgaagctcagcccagactgagacaactgatcaccacccctcttcttgatgaacgactttactaatatagagtgtctcaatggttttccaaagtctacaacgttgtcttctgtgactaatttctcagggaagtaaattactcttctatttctacataattctcatttctcatgtatttaaaattaaaaccatatactctacggaagatgacgtcatcacagattcgggaagaaagaaacactttctgttggttttgatatcacatctctcaaatgagaaggaaacagttcacttccttggatctgtggttccacctgtgccctccagggggcgacgttgcactaaggaggcatctgtgttcattgccgaccatcctcatccactgagcctcctccctgcagctggctgatgtagctcactgatgtctgtgtagatagggagctgtgacgagagcaagaggtcagaacacatccagactccttaagagaaagcctttctgttttggaaacttttcaaagccagggacttgtccagcccaacctccccattgctcctagctcccgaggctcaggacccctggcttctgtcctccctgctcagggtcctgcagcgttgcctctgctcagccatgctcctgctgctcgtcccagtgctcgaggtgatttttaccctgggtgagtaacattccattctttttcctccttttgtaaatgtgactgtgttgtaattgcctctaagtagacttcttagcgaagtcagcgctgcttttgcttacacagcattggtgttgcaggaggaaccagagcccagtcggtgacccagcttgacagccacgtctctgtctctgaaggaaccccggtgctgctgaggtgcaactactcatcttcttattcaccgtctctcttctggtatgtgcaacaccccaacaaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgttgtgagtgacacagtgcttgagactgcaggagagctgaacacaagcctcctgagatgctgagactttctgtgactcaagaactcgaccttgaagtctgttttataatattaaatagcaattccaagtttctgatgcttattgatgtgtgctgtatctttttcatctatttatttttaaactatctatgactttaaatttaaagtgtgtttcctttaggtagctttatatataaggtctttctatccactatgtcaatctctggttttgcactggctagtttagataattataatttaatgtatattgatgaaattggattttagtatactatgttattattgtgtttctgttcctcccttattttttgttgttctttttttttgctgacactttttggattatttgaacatttttaacactattttaatctatggacttctttggttatatttccatattttttgagtggttgctctggagattataatacatatgactaactctccagggtcttctgtgatgttgtacctctttatgtaaaatgtagaaatttttgtataatatgtctctttattatacaataataattgtctcttcaacaaacactgaagtttgttgtagtcgttcatgtatatcaaagctacctatattggaaagctcaccatataatggtacaatttttgttttaaataattgtatggaccgtataaaactcactaggaataataatatttcgtatttaacagctatttactaactctggtatccttcctttgtttctaaagtaagttttcctctgacaccaggagatgtgtttgaactgatgtcattcccttcaaacttaaaaaactccctttaacattttttctagagtaggtttgctggtaatggtattttttagtcatttgttatctgaagatgtctttattcttaatttgccctttatttgtggaagatatttttactgggtctgtaattctgtgccaaccattttcccccctcactttaaagatactgtttcattgtctgctggtctccatgttctggttagaaatctatggtcattcaagtaattgttccccaatgatattaatatgttgtttttctctagctgcttcatatatatgctatttgtacacacacatacacgcaagtaaaatcatatcatcttttgttgtcctcagtataattatgatgtttacatgtggttccctttaatttgttcctgtttggggcttaaattcataagtttgtctttctttgaatttggtaagtttttggccattcttctttcaaatatgttttctggcgcaatctctttctcttctccttctaggactccattagttacaacttagactttaggacactttcccactagctctccatagctctattttgttttctttcaatttttttcttgattttaaggtctgcctctactcactagatccctgtagcattacataccccatgttgtgacacccaaatttctatctagatttgtcaaatgtctcctgaggggagcaaagtcaaaattagttaggttagataacctatactggtctattttcaagtttgttattcttttctctatcactttcattttgctattgagcccttactgtgacattttgattttggatattgtatttctcagttctaaaatctcctttttttttttttttttttttttttttgagacggagtcttgccctgtcacccaggctggagtgcaatggcatgatctcggctcagtgcaacctccgcttcccgggttcaagccattttcctgtctcagcctcttgagtacctgggattacagttgcgtgccaccacccctgggtttttttttttttttttggtatctttagtacagatggggtttcaacgcgttggccaggctggtcttgaactcttggcctcgtgatgcgcctgcctcggcctcccagagtgctgggattacccatgagccaccatgcctgggctaaattttcccttttttaactttgtggtacataatcaaagagctactttaacgtctttttctattacttctagcattttagtcatcttgacctttcatctgttgatcttttacttaaatattagtccacttttctgatcctttgtatgtccaataattttgaaatgcatattaaacattttaaatattaagggtgtagactctgttttcttcttctccttctcatccttattcttctttacaaagcattcctctgaagaattttgatgcttttgctttagcaggaaatcaacctagtttggttcatactgtaaattttctcttcccttttgtggaatttggtagctcaaaatctcagttcagttctctaatcatttgcaatgttggtttggatttatccaagtcatgtgtagcttagggattagtgtgaaacctgtttgggtggctcaaatatcaggtcagccctgagctctctgctacattggtttttttgtcctgcattggtgccactcaggaggtagtctgagactgaaatagtggttcaaatatcagttgaataacccaagctttgttgatctggtttgagtcagtcccaggtacatggagctttgggattagcctgagacttgagctgttttccatttcttccttggggtctgtcttttctagcctggtccacagaggcagaaagattgtgtctctttctgcacaatcttttggtctcctgcacaatcttccgcacctcttttggtctcctataccattgttattgccaccctaccatacaccaggggcctttctaagggcaaagacaagagagaaaaacaggaaaaaatatgaaataaaaggcttgcacaagttgcttctccaacgtttgattttgtctgctttgagtaatttcagaggccacagatagttatttttttgtgtgttttgttcagttttcacttgtaacctgtaggagagatgggctgtaggcgtcttaaagctgtctcctattttactatgttcctgcattaacttatggtctaccataatatgcatcaagaattgctatttgatattttcttttcccacttttattttttattacttctttcagtcaatcttattcattttttatatatgtacttttttttttgtcattaggattataagaatcatctaattacggtcttgattctttggatcttttttctccaaactcacgaaagtctttctttgatgctagaaaatgagcctgtgcacttgtttttaatatgagcttaaagaactattttccccaaaatataaaatcttctggattctgaacaatatctgaacccaagagcataataaggtgtgatacgactatccaaagactatgcttttccagtacctaaagcagagctattttattttcaattttctgctctctctgtgtttttcatttctgaattttcacttattttaaatggaccatgcattttgtgatttatttatttatttatttatttatttatttttttgagatgaagtcttgctctgtcgctcgggctggagtgtagtggtgcgatctcggctcactgtaacctctgcaccccaggttcaagcaattctcttgcttcagtctccctatactagctgggattacagacatgcactaccacgcccagctaatttttgtatttttagtagagatgggattttgccaagttggtcaggctggtctggaactcctgaccttgggtgatgcacctgcctcggcctcctaaagtgctgggattacaggtgtgagccactgcgtccagcctggaccatgcattttggtattttggggtgtgtttggagactattcaatctccctgacaatcaatgtatttcttcaaatgctgtcaacatcctccgatgagagcattctatttctgatcctattcctcttcaactatgagatgttgcctctaaatcaatagagaattgagaaattcctttgcattcttttagtgcagagcaaaaggcagtattccaaggcatcatacaatcctgtctttttcactttgaacacactgggatttgcaaacacccagcaactttgagagacattaaaatcatcaccagcctgaaagtcagcagaaattgctcctcatagtttattttgactatgtttttcctgccctgactttaaacttcactgtgatcccatctacttttgtcttatggaaacatggataaatctattctttccagatgatctttgtttttactcttttggattttggtttgttctcatttatatttctatttttttagttaggaagaaatttggtagatatgggatgtgagtatatagcattaggaatctaaagtccacactcaaagtctatgtatttacaaaatgtcagccatactctttctacacaaaaaacaatctgtacaggcagtaacaaatgaatcaagaacccaaggagagaactggccacatgctcctggaatcaaagaaaataagtattctgactctgtaaaagattctcattggccacagagaacctgtcgaatttctcctttctcttgttttcagagattgcttgtttggtgttggtgtatttccttcagccctagaggtttctgtagttgcgtttaccttagctctaggggcaaagcctttccatcctgtgttacaccttgtcattagtcatatagaggcactactcccattttaagggtcccgtcttttactctatggccgcacaagcatcttccaagggaaatatctctatcatcctccaccaccaacaaggcaactctgaaccatcaaaaactcatcccgaagcagctagtctgcgtccaacgattctcagaaacacagcttaattctgatatatttttaaaacctgatttctcaatgaggtaacgtattactctatttttacatgacatcttattgctaatggactataggcctaaaacaccgtcatagacttgggcaggaagaaacacatggtgtggatgttttgatacatctcagaaattaggagaaacacactaatgagctctctctgctaaactggttctgcacttggcctccagagggcgatgctgcacacactggagcttttgtttctgttgaagatcaatccactgctcagtttcttcttcctgcagctggttgagttctttccagacaaagacaagtgacaagaattagaggtttaaaaagcaaccagattcatctcagcagcttttgtagttttaaataagcaaggagtttctccagcgaaacttcctcacacctcttggtcttggtctcttcagacactttccttcctgttctctggagatcttgcagaaaagagcctgcagtgtttcccttgttcagccatgctcctggagcttatcccactgctggggatacattttgtcctgagtgagtaaaatttctttatggtctctagttccacaggttctgactagaaatgcttgctttttatactgagtctgcactgctttcactgatagtacattgtttttccaggaactgccagagcccagtcagtgacccagcctgacatccacatcactgtctctgaaggagcctcactggagttgagatgtaactattcctatggggcaacaccttatctcttctggtatgtccagtcccccggccaaggcctccagctgctcctgaagtacttttcaggagacactctggttcaaggcattaaaggctttgaggctgaatttaagaggagtcaatcttccttcaatctgaggaaaccctctgtgcattggagtgatgctgctgagtacttctgtgctgtgggtgccacagtgcctgggtctgcagggggagctgaacacaaactgcctatgctagagaagttttcagagtttcagtatatctccctgtggtgttttcaaagatctccttttttatgatggcgaatgaggcaaagagggctaagccgacccaggcatttctatgtaattctgcagttcctgttatgctccatgtcctgataaattttgtttcagaagctttttgctcattgtagaaactatataataggaaatagtattcttgaatgatggaagagatagtattcttataacaatcaagtcctccatgacttaccttgatgttgtctgcattagggggttgaccatgtgagctgtgacatggcctcagagaaaattggttttcatttataatttcatctgtcatctaatctggaaaatagaagatgattttctcatgtttttaccttgcaaatttgttttcaagttggtcattcataggttattttttttagagtttctttttttgcctctaactgtggtatttatgtgtctaaatattttgtctgagtttaaataactctatttaggaagaactgtgagaagttattagtcaacaataaaagagtcattagaatcatgaaggacttagaaaaatgtcaggtgatgttagttccgacaactatttaagaatagtgcagaagaaaaatgaagattaaaaattcatcagtgtttctccaaatactttttcaccgtgagaaaagtagtttcctattcttttagtctcagaaatgctgcaaatctgtatcagaaatttgtggctataatccctttcatttttcttctagctactggcatttctattcattgctttcgccctgttgttatatgatttcagctattggaatattaaagatggattcttataacattttgataatcaatcatgtgataagtttagcaatgccaaactgtgctggaaacactgataagaattacaatgcatggtagagagtcactggacccagtataaatttatgactttcttttgtctaggatggaaagaactgttgaagaagcttttatacttcttgtttgcttgaagccttggagggtagcaagtagtctggagaaaaaggagaaggaggatgaatctttccagctgctacttggctcacgctataatgtattagagggtaggtacgtaggaaccctcaaatatagagagaataagaaaattgtggccaatggtacacgttagccaaatggtgaaccagcagatcagcagtagtttttaggacctagtgagatgattatatgggatagatgtatttcaatgattgctggatgggtataaggaaggtaaatggaacattatagatgtaaaattatgaataagatatgtactcgtgtaatgtcccctgcctcagtccctccattcttttctatttctaaagcacactgtcttctacctttgataagatggctaacttcaggtgactcactgttatcagctcagccacattgcccacagggactgtgatgggcactttatgcgaatcttaaaggaggtaggaacatagaattgttttgttgttgtatgtgtttcaaatgtatgtagaaagttgtatatagaagtcgaatagtccaaggggtggattgatttattgactctcagctccaaattcaccccttgcctcttccgtgaatgtggatctgtacccttcaactatgttccttgccagttggcataacgttatgctttgccagtagaggatcagggagaaaagattttgatttttgctttctgtgtgcacatgccacaggttcctgcagcatgagaggcttctccagcgtccggctcctgcagtgcacccacaccaggttcctgcgctgtacagtggccagcagtgtcctccagcacttccatttttgcgtggtactgcagaacagagcctgcagtgagacaccttcctgtatccagctttccccatattcatccctagattcatgaatcggcaccctagattatggttttctggtaagtatgagagggtgaatttctctgtagaaaattcacagcacaacagtgacttctgtgtcatctagtgagacacagttgtgcctttcccaataagatctgggtctcacccctggggggtgggtctaggggtcccttcttggggtgttgtacccagccctaggagtagggactgcaccttatatctgctattcctacaggaataggaatagcagagttttcttttctttgtattacctatttccttgttactctaaatcctgttataattaataattttttatattaatattaaattttcctataattataaaaagcattttctgttcaaattattatatggtctatctttcctgattggaccagatttatacatgcaccaaggatctcaagccactgaagagcatctccccacccagtcacctgacaaatctagttgcttgcttgttttatttattgctcatttgttttatttatttatggtttattattttacttatttattgttttacttatatgattacaagaaactttatgcaataaagaattacattaagaagaatttggaaatatgtttttatattaatgaaattaattttgatttttcacattttgtgcatgtttgacacaaaattttattataccattgaggcaaattataattccttttaaatgtattttagcttacaacacaaattgtctttcattcactaatgagactgtgtctgaagattttaaattccaagtcatttttcattcatctaactctgttaattatccttatttttgatttctttaaaatggagggaaaagaccatgataactttaaaacaatctgaagacagaatacttctaacacccagaaagtttttgtgtgtgcctttccagtcaacccaccttctggaggcaacagatgttcatatttctagtattacagagactttaaccgttttaaaacttcgaatcaatgggattattcagtaggaactctcttctgcctggtttctttcactcgtcatgttctggaggttaatccgtgttcattaccgtaattgttgagaagtttcctattatatgaataaagcacaatttatttattcatttggctgtgcacaccattggctgattacagaatcttttagggattaaagctttggtagcattcttttttttttaattagattcaggggttacatgagcaagtttgttacatgggttcactgcgtgatgttgaggtttgggcttctaatgatcttgtagtgaacgtagtaacctatagatagttttgcaacactttaccctccccccatctcctcccttttggaatccccagtgcttattgttctcatctttgtgtccttgtgtactcaatgtttaactcccacttataagtgagaacattgtgtatttggttttctgtttctgtgttaattcccttaggataatggcctccagcttcatccatgttgctgcaaaggacatgatctcatgctttttatggctgtgtagtattttgtggtgtacatttaccacattttcttcatccagtccaccactggttggaatttggtagcattcttggtgcaaggtataggctgtcctagatttttatatgccgttcaggcaatggtagggtgtgtctctgaagttctatagttgaaatccatatcttaaatacttttatttaaaaaccaattcctaaatttcattatgctatttaacatgtcactaatttttctaataaaaacccaatatctgatatttcctgtgctacttataaaagcttcaggtatcattcaagctgtgggtagctgaactgtagtttcctctgttgtggccttacgtgttgataacaacagtagctgaccgccttggagtttgctttcttgactaagtgaattgactctccttagagttgagacttaagttaaccagctcatgcttgatattctgtggtttctgttgaaaagatttaatgtaaattatataacctagcactttagtatatttattcttacttggtaacatatatatatatatatatataaaatgaacaatattttgataagtgttcctgcaaatcctgaagatctataagtcatgtaattataatccttgctcaacagtcattccagagaactcatttaatatttagaggcattttgctatatacagtacatatgaaaatattttaaagcttgttaggtaacttataaaggaaatttcgctgttatttaatatcacatatgcagcacatccaatacaaatttccaatcgtttaagcacaataataaagttgtcaagataattagaggtctgtacagaattctcatggggatatctaagacaagggagcacttttattcaggaaacaagtgcaccaaaacatgagtgtaaaaggtagaatgttaagatgctgaagatactttatatgtatatttatgacttcaagttgctctgtgtgatatatttcatataactggatattaaaaatttaccttcacattaattttctagagctgccatgacaaataccacagacggggtggcataagcaacagaatctgtttttctctcaattctggagatagaaatccaagattaaggcattggcagggcaggttgttattgaggcttgcagatggttgccttctcaccgtgccttcaggtggtctctcctctcatggtgcacatgtctgtatctggatttcctttcttacaagaacaccaattatgttgagttagagcccagctatataacctcattttaccttaatgacctctttaaagatcctgttttcaaatacagtttcattctgatgtactggggataagggcttcaacatgtaaattttggatgagacacggtttattctgtggcaaccctccagggaaataaatatcaaattaatgaagaagacaattaaagcctctcttgacacaacactttgctaattgctggcgcacacaatgatcatatataattttgatgatgaattttccctgctttcttttgtgattctagagcaattagaaatgtgcaataacagatgcagatacttcctaaatatttcaaattgtaaaggaagtagagagtacaatgataaaaatgtaaaagctattatttagacttgccttctttctctctgctacattaggatatggaattttctcatgttaggtttgtccttttctgcagctaaatcttaatttctttttggttttccatctcagatagttttcctttctttctctactcttttctgtatgaatgttgagttttttaccttgtcttttttttcctctctcttgtctctgatctcaactttgccagagctattttagcagactaacttgctattcttatcttgcactactcttttactacctaatcagcagaagtgacatttaaaagaagcgaaaaggattgaaattcttttggaagttgtttatggcaggtgcagtgggttaagtagatgagggaggggtgctatagtccttgaatacagaggcagcaggaagaatcccatcctatatgctcagctttcttggggcttgttgtctgttttttcaagcagtatgtggcaagatttttaattttgattgaatcatagtctttttaaaaatatgtttcgattactgatacatttggattcattttaacgttttggctctgctcagcatgctcttgatttgttctttcgtgttttagtctgtcttctgttgcagtgatagttttcttttttctttctattgttttagaaagtgtaaattgtattttttgttcctaaaagtatccttatattatatatgtatacatatatataatttttaaatacccaaagttgttattattttttcctgaagttattccgtaacattttttccttgtatgtccccctctttctccttgggtatatttttttctccttttgacttactgtctttagaattacttctgtagctaattggaagaaactatacacatactatatatatgaagacagtaattttagagtttatcaaattagccaataaactagagctccaatgcacactaacaaaagtaataaaaaagaaaaccattcaacacaataatgggaacatgaattcattcccttcttcctcagagcctttgcccgatcttccctctgcccggagtgcttttcactactagccacactgatggttctttcactagttcctagtctctgctcctgaagaaacatgagcacatgtgaataaaaagaggaattctttaaaagctttattgccattttacattttatggttaaaaaacaacattttaagtgttgatcaataggagaaaggctgtataaactgaagtatatccctaatatgatgcagtatagcagaaggccccatatgaattaatacaataagacctaaagatttattattgagtttataaagtgagttacaaaaaggtatgcacaagatgtatcatttttattacgttttaaacctataaatgaaatgccgtatatttcagctgtttcatatattttgtatatggatgtagatagagcatcaactccaaattgattagatgaaacaataaaggtaataagggatgaacggactagaactgggagtagtggtcgaaggagattttagtctatctggaatgctgtattactttaaattatttcatatatttgtgaattctttctagtattaaaccaaaaaaagtcataaaagccatcacaaaggtttatctacattttttccttgtctactcatagaaaaagggagagaggagaaaacgatcaccttcttcattagcttttgttcagccttcctacgtattttttttctgcctctgggatcatacagcttctagtttacactcctcttaggttcctactatgtgatttatattatagatatgtatttttgtccactccagtagaccataaaactaatattacatctgcttttaagtattcttaaaacctaataaattattcacttagagtaaaactttaatacatgtttttggacttactttgaactaaattaaaggaattaagtgaagagtacaaaaagagaattgccaaattaagatactgatttccacgaaatgacattttaaagtggtaattggttcattcttaatccccatccaatctaggcagttgtattgttttctgaccacctccatttccttcataggaaacagtaaatggggctgtgtgtgtgactactgaggaattagttggtccgtagtggtttttgttgatgggttcagtccactagggggcactctaggatttccagaaatgaagactttttctgatggtcccaaagggtggaacaattaaaagagaagacaagggggcatgtgagtcagtcaagtcacagataacaaggaattgcagtggaatggggggcagtgtgtgtgtaaagttcatcttcggttttcagctctgacattctatatagaacctcagaaagctggagttcataggtctacgaatccattgtgaggatgattctataagcagaggtaagggaattggagttttactgggaattgggaggatggacactcaatagaaaacatctctattacatattttcagtttttaaatttttatgactaaaattcctgaaattcactggcatggaaattattccaaaatacccctgatatctgatttcttcatatatcttctctgagaccaaaaggaacaagaataagcagaaaagaagaaaataggaaggaaataaggaccaaaaccagaaagagaatagagaggagaatatttaatttggccagcagtatgtggtctgatcgtaacagctgtgtgggcctgcagggtgtgtagggaaagggttggacagagtgggagaggtagaaattaaatcagggtggatatcatacacacatcctatttttcttttaaccaaacaaactctagttggaaacattttctatgcagacaatctcctgatttcaagaaattgtatttatttctaaatccaccatacatgctaccagaaagttttccttattaaaattttcatataattgaattttgcaattttctgtccagctatgtaatttgggcttcccatgattctttaaggctctactttccccagctgagacacggattcttctcagacgtatcatcctctttcttcacatactattctacaatttctcttatataaagtactttaaggaaaaaaaaaccctgtaacttcatacactggaaatattgactcttccccccttgcactattcacacccagagttttggagagattactgtgcggtctcaaaggccactgctggtggagtttcctattcagatgaatgacagagctcaggtgtgattggtgctcagggagtctggtgcaaactattgactgtaagaacaagtttgtctggacccaagacttgaccccttccagagcagcggcaaaggcaccccagcaaccaggcaaggagccatggagaggagactgggagctctcttggggcttttgtgggtccaggtttgctatgagttgggccgtcctagatgggggctgacaggggaagggagggaagggagagctgacacaaatctcctggactgtcctacagcctcataagtgtttctagggatattttacaggcttggaaactgcatcagtgattccttagtgacataatacatatttgcttttctctttccaagcaggggtgagacgagtgaaggtggagcagagtccttcagttccgagtctccaggagagaaccagctctactctgagatgcagtttttctacctctgtgaacaacgtgcagtggttccaacagaatcctgggttggcctcatcaatctgtttttcatggcttcatggatgaagcacagtggaaagttatggtcaaaaagaaactctgaggagctctgtggtaccctacacatcacagccgcccaactgaaagactcaggcacgtacttctgtgcagttgaggcacagttctcccaggaaatctgcagcctggatccgaactgcagctgggcctgcagccccaaccccttccgtgagagaggcatgttgcccccacagtatcacttgcacagcttcgggttttctgattgacgttgcgcttttatctctgctaaaattagacacttcaggattgccatttaacttttttatcctacccttttgctctcagaaatctctttgcaggaaaaagctttgatatggaaccactggagcaacttttaaagatatcaggacccaatgtactgttaaaacagatcctctagcaaagagcatataaattacatataaattactgtgataaaaaagatttgaaaaaatatatcctggtcaagaaatagcaaagagcatataaattacatataaattactgtgataaaaaagatttgaaaaaatatatcctggtcaagaaatagcaaagagatgactcaatgtttcatccaaatgcatgttgttcacttttctagtaaaagggaagagagcatgtgtgatgtatattatatataattttttactcctggaacccataaaagataaaattttaaagcacgtaacgtcattggatgtcagacattctctgaatttacatatattatctgggtgctgacaatacctctttactctacacatgaataaactgaggattatagggcacacatgtcttgcctgagctcagatggttatgaaactagcaatgaagctgggctgggattctccttctcgatgtttgaaagcagagtgtgtactctaagctacacacaatagaagacccttgagaatcacaaaataccaattatttcaattgataaatttgtgcaatgtgctcacatacatcactggcaaatatatccgttgggataatttctaaattgcatctagtaagaaagagttcattaaacttttcattttgttacattaaaatccatttgtcttccttgcattactcatgattttgtaacatcattcaaggtctcgaaaagagaacagaaacttctagggttgccccccaaaacttacctgctgtagccgcagtccaagacttctgagaagcaaagccaaagtttaaacctaaatgtggatcagttacaacacatgtagaatttcagccttacaaggtctgttatatgaatgtaagagaatggactaggaaggactggggccctgagaaccaagatgaagacaagctggcagtctccggtgaagctgggagcagggccagcttcctgggtatgtgatctgttgcagcccacaggaccctagttaatgctctgctatcactgccttgacatttttaatagttttgtttttaaacttgtgtgagtaaatgaagttcaatgagaggacagagcatgtaggtgagcagaggagatacacaggacagcaggacacaggacagaatcatatgcaggctcaggttcatgggcacagtgggcagcatgtgagccgagcagttggatgggctattttgagtgcatgagcacacagggctctctggtgttttgcggctctccaaagtgagtggcagtaaacttttcagtaaattattacacaataaaagcatatacatggacaaggcaataaggtatattggagagttattagaatccttcaaaaagtttagagactgtggttttgaaagttgatataacattacaatttggatatctgctggtttagaaatagaaattacatgtaaggatagcagcttaatggaaaagagcatcattttctcaccttttaatgctatcttcttttgtttttttccttaacatcttttttttcaacttttattttagaattgggggttcatttgcaggtttgttacaatagtatattatgtgatgctagagtttggagttataatgaatccattacccaggtagggagcatagtactgaaaaggtgatttttttcaatctttaaccccctccctctgtcccctctcttgtattctccagggtctactgttctcatttctatgaccttgtgtgcctaatgtttagcccctacttataagtgagggcatgtcatatttggctttatgtttcagtgctagttcacttagttatcctaagttatcctaatggtttccagccacatccatggctgcatagtagtccatgttgtatatgtaccgtgttttccttatcaaatccactgctgatgggcacctgggttgattccatgtctttgctattgtgaatagtgctgtgatgaacatatgggcacacatgtcttttggtaggatggttcattatcctttgggtatgtagccagtagtgggattgctgggtggaatggtagttgaactctcagttctttgagaaatctccaaactgctctctatagttgctgaactgatttacattcccagcaacagtgtataagtgttgccttttctccacagcttcatcaacatctgctattttttttggctttttaacaaaagccaaacattgtggttttggtttgcatttctatgatgattagtgatgagcattttttttcatgtttccacttgtatgctttttttttttttttgagaagtatctgaagagcattattttcatgtgaagttttgaacagccacgttttaacatagaggataatattgaaattaattaactttttttttttttttgagacggagtctcactctgtcgcccaggctggagtgcagtggtgcgatctcagctgactgcaacctccgcctcctgggttcaagtgattctcctgcctcagcctcctgagtagctgggattacaggcccctgccaccatgcctggctaattttagtagagatggggtttcaccaagttggccaggctggtctcgaactcctgacccgtgatccgcctgcttcagcctcccaaagtgctgggattacaggcgtgacccaccgtgcctggcctgaaattaattttttaataattgaagatacagtgataaaattaataaacaaggattttgaattatatctatatcattaagccatttctagtttcttatacagcttccacaagttactaaaaatttcagaggaaacattaaaacagcactgtgtaaatttacattgaaaactgagttcagacgtacataaaactgatttgtggtaagaaataaattgttttagaaaaattgtttcacagggaccatcaaccactgatttactaaaatttatatttcagttaatccatcagataagtatgctaatgttgtcacagtatataaaatacttttaagagctccagtatcagttgcatcagcagaaatatccttctcgcagttagaaatgaaaaattctagttaagattttgcatttaataagagcacttgatattgctttcatttatatgcttgaaaatgaagttgctccaggcatgaattttgctaacctcataaattaatttgcagcaaagtgatccataaaattttattaatcaagatatcatattaaagtattattatattaatttatgacaccaaatttttaaaccaattttatgttttttcttatgtatcattataaaccctattgcattttataagtaataaaatattttaagaaaaaaactttacagtttattacctaatggctatttttcctgccttttgaataagaaatcctaaattttcgttttgcactgagtcccacaaattgtacagccagcccagctgggaatcttgaatccccaaactaaattttgaaggagagattttgaagtctgaaagcaatcaggatgtttgagaaagtgccttttgctttacatattagtaaactcctatacttcttccatgttctccaagttgctgaggtgtgtgtgtgtgtgtgtgtgtttcctttaagacagacatgatacgctataaagataagaaatcgatatccagaagggagaatcctgcctccctatagcccagccatggtgtccaccctcatatcactgcttgtgatggcctttatacttagcgagtaaagtctcatttgatttcattttactatggatttaggcttccgttgatctaccatctatcactaatgttgtaggaggaatgaaaactcacataggaactcatctggaggaccttgtcttttcttctgaaggggcccaaggattggttagggtaacctcagacccactagattgcatattgatgtgaaaatggttttggggttccatgatgcaagacaatttctccttgcattcccatactttacactgtacacaactagtccttaataaatatttgctctgttaaatagaataaaataattttacagctagaaaagcacttagaaatcttttagtccaatttcactttacaaagagagaaaccatatccaagatgccagtatggaaccattagatgagccgggagtagaaagaaactggatttcctcccttcctccttcgtattgtttcctctgcctcattcctgcaggaccacattgctgagcaaagagaaactgaggaaaatccagccactttgacctctgcagtttgggtctgggaaagacttggtccaatcagtttgaccatgagaatggagagttccaacttgtgtaagtaaacatttgccactttgggccacagagatactcatgaggctgagccattgttattctaccagcaaatcagtccatgactcactggcttctgtaggagtgagccaaaagtgatggtgccatcctcaacccctggatgtatttctgagaattttcctaaaaatagcaagatgtgtaccttatggtgggtggatattccttgaaagaaggatgtgaacataaggagcatcactctacattgtttaaaaatgatcactgaaattgggaagctaaggggaacattgcccctgtgtagctggcagttcatgaaagtgctggaaaagcttttccgggccaaccctttgataatgagtctggcaaaaaacgaaataatcaccaggctgggaattttgtccagggcacggctatattcaaggtacagttaatatacggaacgctgtgctccatgtgagtggtcatattcagaccattacattcagttctggatgtcgtaactcaaaaggacaaatattaacctatgtatctgtctccaagaagaaagtaatttgctcaatgaaggatttgataattgtatgaggaatgggtgagataactgaagatccttagaatggagaaatttcatatatgtaaaagcacacattatatatatacatatatttatgtattgagttgagattcttaatcatagctgtctgtaaatatttaagggtgtgagatgtgaataaataattagatttagtctctataactccagcagactagtgagtacaaatcacaggaaaggggctttcctcctggaaatgagaaagtcttggtttcccaggtaccatttctcatgatcagtattttactgtcagttttctatttgtactattctgctaacaggcacaggaaatatttagccttccattaatttattcttacagaagtaattttaaaatttcaaaagttaaagtagattagaaagttttttttttttttggcagaaacagataaacctggaaacatacaggactgaaggactttctcaatatcttggagaaaaacattatggtggagtttgggagaaaaatgatagatatggaatctgtgccagcaatggctgagacaacagcagttcatgacagaagagttgactcatactttagaggaaattccactaaagatatgagtcagtcactgtgtttaagcacatatcatattgatatcatccactttgatatcaaaaaataaaattatctcaataataaagttacatatgcttacattttttgaatctgcagcctgatgttttctgagaatttcttcttgttttttcaacactttgcagaaagcaagccacatagccataggaaaagacttcttaaaacatgccagatttctccttgcaaaccagcccagtctatgggtcaaactattcctattgttggagtattaataactcatggaacttgtccccctcctcctttatcattgtactttaattctttaccttttattaaagccatctttactgaagaaatattcaacattttgattgtcggtaccgtcaattctctgggaatagcaaggtcatggcccaggcttgagaagcagaacctgagataatacgcactcgaaatattgagtggtcctctctctcttgctctgatctttggcttacatattgcctaaagaaagagttttcttcataacaaacgagtcatgatagtagacttaacctaaaaggaaggcattattttttcttgtttatgagagcgaattatggtattttcttaatttcaaacataaactcagcccatcattgaataaatatcaacagcatctacttctttataatttatgaataatgactcagtagtgtgcataattatagagttagatctctacattcttactgtgcatttaatctctgattgaacacccagtctgtttgactcattgctgcttttgtgcacctgagtgcctcatagggttagagaaaaacattcaaccagcaagttcagtagttagggatgtggccacaagatggcagtgctcctctgctgaggcagaatacagggttcactttagtgtgtcctgaatgaataggtttatggtagcagcagagcctttttcttattggttggctacacagtgtgagaaacccctatggctgccagaggagagaagagacaacctgatgatagaagtaactcttataactggaggttgcaggtcaatgactgatcttaattgggaagaacaaggatgacatccattcgagctgtatttatattcctgtggctgcagctggactgtgagttgagggtatttgggtaacagagtatattagtgaatattcttcagcagttcaaagaggagacttgctttattcaggtttcctctcgttactatgaaaaataattctagagagtaatgacctaacaatccctcttctttctctgattttttctttctgcatagtggtgaatggagagaatgtggagcagcatccttcaaccctgagtgtccaggagggagacagcgctgttatcaagtgtacttattcagacagtgcctcaaactacttcccttggtataagcaagaacttggaaaaggacctcagcttattatagacattcgttcaaatgtgggcgaaaagaaagaccaacgaattgctgttacattgaacaagacagccaaacatttctccctgcacatcacagagacccaacctgaagactcggctgtctacttctgtgcagcaagtacacattgcttcccaggcacctgctacccgtacacaaacctgagactggagctgaagctgcaccccctttcctttgtcatagatcgtcaattatagcatttgtcatattgtttgtttgcaagttgaaactaacatattgacatttaaagcatataataaaaaggttaggttcaatgtttttgtatttttagtagagactgggtttcacatgctcagctaattttttctatttttagtagagatggggtttcaccatgttggctaggatggtcttgatctcctgacctcgtgatcctcccgcctcggcccccgaaagtgctgggattacaggcctaagccactgcgcccagcctaatttttgtatttttagtagagacgggatttcactatgttagccaggctggtctcaaactcctgacctcaagtgatccacccgcctcggcctcccaaaatgctgggattacaggcgcgagccaccgcaaccggccctatcttacacattctattagtagattacaacaggactttggaccaatggttaatttacagacagcttgctaaaaatctccctgcctcattttcatgttttgactgaattaaacattactaccacaatttcttttaaaagagttatatcttttagtgttgtagataaatcagtggaaataaagaaggtgcataaataattaattccctatttctcccacctgtggtcaagagtaggctaatttcaagatctcttgtattcttcctaaggatggatctaatcagcagttggaatgggagaacaattcctcctggctgagttttggctgttatggcttgttcttatagggaaagtagttagattaaattagggttaaaacagctggacaagaaaggtcagctgttccttgtctcttccggctctgagggctgcctgcatttcttggcttgtggctccatcactctgatctctgcctctatggttgcactgcttctcttcttctgtcatctccctctgcctccctattataagcacacacgtgattatatttaaggcccatataacataggataacttctcatcccaagatccttaacttaatcatatctgcagtgtcttttttcccttggctatataagataactttcatggattccagggactggggcctaacttttttggagcccttattttgcctaccacagttggcatgcctggtgctatctttttcagaagttgagaaagaaaatcagagttccagatagaaaaatagaaaccacatcaattgctttattttattttctcagtttttacaattttcagtttttaaattatcacttaaaaaggaacacattttgatatgcagttcaatgtgtgaaatttgaattttgatatattgcatagtttgatgtaaccattacataactatgatacgaaacagattgctcatcccaaaaactcccttgtgtgatctgtgtgaaatcacacctccatctcaaactccttgcaaaccttggtctgttcttttatatttttatttttttctggaggtcacatgggtggaattatacaatatataatcttttgaaaagtctgaatcttggttacagaaagcacacaccattgggcacatacatgatcatcatctctgctaccactcttttttttctatacctgaatgttttaaacttttgtcattttacaggaataactcaacatttcaaatgtttgaatttctttggaggtttgatttacagtttaaagaaacactatggcaagtatagtgtttaaggaaacggtatggcaattgataatggagaggttcagttgaggattgaaccaactcctagaatcagagttaaacacatcaagtttagttgtaccaacactaccctaaatttttatcaatagatatttctctaacattttaaggctaagtgtattgaccgaaatgtattttagtcatattaattgggtatggttaatacttggattttcccaggagttagcatagaatgacatatctcacaattatttaaattttttgcactagctgtggctttgtagaggtgaaaagtgttaggatggttattacctcaagtaaagcctgtacctaagcaaattgttttattaacaaaataacaaagtggaaaaaaattacaaatatatgcaacgttgtaccattagagttgaaaaataccaccaaatggatgaaaaagaaaagaatgcaaagatagtataacaaccactggttccagtcatctagataatactgttcgattatacttgcatggagctgtctactttatccacttatacatgtgtttcaaggacctcgagtctgcactcattttctgaaaagcccctaaatagtctctgaagaaattcagtttaatatctgtaatatgaataacttctcaattcttgccatttaaggatggataatgtcaaactaattggtacaaagtaaccacagatcaattcctcgtactttaactgttgaactggtaataaacagtacctaataaggtcattttcacaaggttgaaaggcagtctttctctggaatttttttccaaataccaactcatccaggcttaggtcatgtaaaggctgattaaatgaaaggccaggaaagaaaactgtacctgttggtataaggactgagtataatgggtttatttatctagataagtttgtgaaagaatgaactatataggattccagatactaggagtaatatggacctacaagtcaccagttgatagtaagacaacctatgatggcagagtgaacaactcagggccatgaaagtgaagggtaataatatattagatcatggaaattcaaggatgtctgataccgtaattaattttagttttaatatttctcatgtgttgtgtcttcatttatagaggataaggaggtgataagaaaagagaagttctgagtgagggcaaagcattatataacttcccggaaaattgtgttcccctatatatagataatttgaagtgtcacatattcaactgtttccttaggacagtattccagttcatattccatttttacacttttcatggaatcttataggtttcaaaaaaggcatgaacttgccactttctgtgttctcctagaaaagttttccccaactatttgtataatattgcagccagtacatccctactgtgatgggctgtctctggaaggttgctaaaacaagtattcactggagatcatttggtcccaccaggcagcctttctggccttgatatatcttatcctcactgatcaaacaaatcaataattgatccaagatgtagttactaaaattttccatagatttttctgcatgttctgtaagaggtacttgcatgaggacgttagtcagaaaggcatgtttagcatgattctctgctcatgtatttcttcctggcttctatagtgtctttcctactttggaactttgtctttctttgagtagtatcaataattcaaataattttcgtatttggtgtctattttatagcgatacatgagatgtatgaaaaggttaagaaggttaagaaatctcatcatctccatagtatttgagagttgtgaactatgttaaaacatataggctatcactgtatatatttttcataattggacatagcaaagagagagccacaaattcagttactttaatttgttttgcttcttctaaggaattagattttataatggagtctggagcagtaaatgcattataaaccttgtgttatttcttttcagttttgaagataagacattaaaaacaaaattaattcagaattaggtatgagactgtccaaaatatctgttctgggatggacacttcttgagttacagaaatgcaatcataagattcattgattgagaagtgtaatggagttagacgctatgaggagaaattaataatattgtatagttagtccaccaactggtaaaaaaatggttgtttttacagagtagatcatttgtgctgtatgtggcatcataagatttaatggtgatttcagtgaaagatctggagatgcttcaacaaatttagacatagctgaaatcattttaagacaaggaggataggttgtaatcattatattaagaaataggctataataggcaatgggtctttgttgtttttaatgtaattgagtaatatccctaggacatggccttactgctaatattcacaaaacgaaagccttatcacaatcaattttcctataatagtttttccttgggagacgtatggagacacctaggattcatacctttcagcagtggatgtacagaatgtaatggcttgttatggctcatttggggtcccagatgacataataaaaatgcataaattcaaaggtttgataacttaatgatcagagtctggtgtctaatatggcctgtataaacagagctgggctgtctaaactaacttgaaaaaagaagaaaacttttaagataggactcaatgtctgagggcttcattctaaactctcagaaaaaagagattagtttttttctgcgtagaaaagagaaagagagattagtttttttctaccgtttgttccccagataagcaactggacagactttgggaataggacaaatattgctatattaacatgtaggtccgatgatctgcagtgattagtgcaaacagcttttccttcttagcataatgtgattaatttctaccttaggagaaacaacaacatacatagatgtgaggatacataattgttacatcttccgttgccttcattattcattacatgtagtattttaaagtaagtgccaacctctcaacctcattgctcagttccatcacagatgcaatgactgaacatagcaattggccgaattatcaatttcccttctaacctgaccatgtttattttcatatttaagttatttattatcaaattaagggtgggtaagtgcaaaggaagtttgcattgggtgaggttcttagccagtacatagagaagtgttagataacacaaactagcttgctacaccggaaaacctccgtttcctattccagggcagcagcagcagcagcagcacatagtccagtaattcttctcttacttcatcagactcacctcacaatgcagagccctgaattttaagaagaacaaaatatattctctctagagaaagaaccaaacatgttgctctccagctgcctgagggtggtcacagcttcaatgtggctaggtagggatgcccctggtgggaatggtcttcctctaagacccaaggactgggaaatgtctcatcaaaactttgggacagaagaagtaacagggtgtaaaaatagaatttctttgttccacatcactcatccctaaaccttttggttctttgttttctccttcagaatctggttttgctgagaagtaactcaaattaaaccatcagtattggtgcatgagaaggaggctgtgactctggactgcaattatgacaccagtgctggaagttatagtcctttctggcacaagtagcccaggagtggggagatgattttccttattcatcaggactcacgatcagcaataagcaataggtcactactcattgcatttgcagaaggcaagcaaatccatcaacttgtcatctccacttcacaactggagaactcagtgatgtgtttctgtgcactgaaagaggctacagtgagagaactgttggagtgaggtacacaaaatccccaagggtctgcttgagacatccacttgctggagagaccaaagaaaggattcaccatcacagacaggaagtggctatggttgtgacagcacaggtgtagcatcgggggaaaacactgtaagaaaatacctctctaggcttatagaccatttccagaattatcattcatcaaaaacatcctaatccctgagtctttggtttgaagttagacacaccaaaattttgaccaatgattgagagaaagaactgccacaataagcaatttgccatctggccactagattgagctggaagaattggctaaggtaattcagaaacatatgactgaaagatgaataaaaacaaattcaacactctttgtgaattgttggattttcagatcagtttattcaataaatgctaggtgtcttcaaaaagtttatggaaaaaagaaattgcgtattatgaaaaacggtgcatggatttcaaattttctggcaccaaaataaacttatactaagttgttataacatatctgaacaggatttagtttgaggcactaagaaggataagacatcagtttgaaaggagcccctatcagagcaacatgaattctgttaaacttgaggcaagaacaaacatcaaatttatggtgaaacttgggtggaagaatggtgaaatcactgatgctttatgaaaaatttataggctcaacactccaataaaatcagccatcctcttgtctgtctgttcttaaacaaaatggataatttgtttaagaatagacaagaggatgccgatgaagcccacagtggcagacattccataacaatttgtgaagaaaaaattaaccataagtgccctaatcaaaaaggacggatgattaacagtggaaacaatagccaacactataaatgtctcaactggtttagctcacacaattctgactgaaaagttcaagttgagcaaactttgtacttgatgggtgccaaaaccactatgctcagatcagctccagaaaagagcagagctttcaatgaaattttgaataagtgggataatgatcttgaaccatttcttcaaataattggaacaggagatgaaacatggctttatccttttgattctgaagataaagcacaatcaaagcaatgattagcaagaggtggaggtccagtcaaagcaaaagtggcccagtcaagagcaaaagtcatggcaacagttttttgcgatgctcaaggcattttgtttattgagtttctggagggccaaagaatgacagcatctgcttattataagaatgtttagagaaagttagccagagctttagcagaaaaatgcctgggaaatcttcaccagagaatccctttccaccacgacaatgctccaacttattcctctcatcaagcgaggagaatttaggtttctgtgggaaatcattaggcatccccctcacagtgctgatttggctccttctgacttctttttgtttcttaatcttaagaacgtctttaaagggcaccacttttcttcagttaataatgtaaaaaagactgcattgacttggttaaattggtggctaatcatccagtaagtaagcaagaagaatacatattcaccgagaataaatatgtatcccctatgtgtacaacgtactgtattaggacctttgactataccgacagtagtataaaatgttactcttaagcagaatgaacttaccagaaaaatcttgcaaatcaattgaggaataagatgaaatgcatgaaaacttaaccaatagataaaattccaagtatgtgggcaattaagttttaggggtatttttaggagaatagtgtggcaccgaaaagacacaagtaagcatcatggagagatagaaaacttaggcattaaacgacagacacacattgaattcattcattatacacttacttatgaaacacacaataagcaacaattgtttttgtaggtatgaagagtagaataatgaataaaacagacacatgcagacaacaaagaccttccctcatgaggtttagatctacaattgtctatagtgttcccttcttttacaggaatatccaatataggtatttccaatatatctgtttcactataggcatttgtcttgcctattctagtgattggcaggttccatgtgaccattacaaggcatagtcactgaagtactattaatatacctgtcatttactaaattatttgaccattgacaaaattacttaaactcaggccacctagacatcatcaattgtaataacaataacaatcacctctccacatagttgtaaggattgaattaaatttcatgaatttaattaaatgattgaattgtagtggtagggaacaatttctcaccaatggtagctatacttggatataaatgagatattgcaacaaagacaatttgaaataaaataacaagaaaatttaaggatagataaggcttaaccctctactctcctgctattggttatattattatattttactatatttaggactgagagtcactatttcacactggcctgattccatccaattatttgaactatttctttatctcataggccttacgggtagagaatgaagctttcttgcttcaggtataacttagtgtaaattctatgatggattcacatgagcgttatggagcaggagtcagatatacaccattttatactgagctacagtgccaataactagatccataactgggagcttatttaacagagctctgctctgggagaaaataacttttctaggtcatccttgggggaggaatcctttttagttattcaatttacaacttgtacatacatggtagatgcccaggaagtattacagaagaaaaaaggaaagagaaaaatctaagggacaaatgctagatgcagctgactgagaatcagcacctggttctgccagggtcctttcccatgctacctcttcagagatcagagacagctgtgcgatctgtgcatgggggagtaaatcttgtttctggctggatggggagactctcagcttcctgcaacaaaactatgaatattcactcagagaaacaagagatttggcttggtagtgtttgagggctcccaggccccagccagagtcctccgtgagtctgagggataaaaatgaagaaggctttgggagtttcattcttgattttctcttgggagctgtgctgtgagttgctgggctctggaaatatgaaaaagagcgagtgtagtatcttatttaaaagtctggaagttatagaagggtggttaaggcctcagtgctcacctgtgggggctgtgaaaagagagcatatcttctaaaagctgtcagccatgaatgaatgtcatctgtctgtgcttctctgtttaaacaggggtgaacagactacatacgccggagcagagtccttcattcctgagtatccaggagggaatgcatgccattcttaactgtttatgtgtagggggaactttctttataacctctgtctccaaacagaagtgaagaataatgcaccatctctcatatgtgaagaagctgaatttatatggaattatgtttccttttgtcattattgaaatttcattcctcaatgtagaccatacagatcctgggcctgcttgcccagagtccttccactcctttactgtttgctctgagaggtcacagtctctgagtccatggagcaaagtttcccctggttgtacacttagcagcatttaacttatattttcataatctttaaatgatgtttgctgtatctgtgtatcatctactccataatttacttaatttaacattaaattgatttctctattaaatagatgccaaaaatatgtaaaatattgtccttactttaatagatactatcagtgggaccacatatatgttataaaatgtgcatttgatgtgcaagatattttttcctaatacaaattaaaataatgttacatatataacagtcagaaagaccatctgtgttctgcctaatatgacctcctgtatcaatcgcactttagaaaatacatttccagctcatgcccctcatttgatagatgaaaaaaagcaggctccacaggcatggcttcactttactcaaagcatgtgttgcagtgaaatggaagcctggagtagaagccaggcattctggccccttgtcagttgctttttccatgaaagatgaaaagcgggattcggtgtttgagaaaaggagttgtgtgttgtaattttgaactaaattacatttttattacttatatgtatatataaagatataaaatgatatataaagacataaaacacccagaaaaatagaacacacctataatttcataatcaagaaattataactattatcctgtaaaaaattttggtatacatatgtagctattttttctataaaagtggtttgcaatatatccagtatttattaccatgcttgtttttctcaacattatgtttaggtgttttcatcccaggaagcttatattgaaggcacagttttattttattttcttttattttcaacctttattttagattcagggggtagtacatgtgcagatttgttacctgagcatattgcatgatgctgaggtttggtgtataaatgatcccatcacccaggtactgagcataataccaacagttattttctcagtccttgccccttttctccttccccctctagtaatgctcagtatctacatgtagtctttatgtccatgtgcactcaatgtttagctcccacgtatcaatgagaatatatggtatttggctttctgtttctgcattgatttgcttaggaaaatgatctctagctgcatccatgctgttgcaaaggatatgatttcattcctttttatggctgcatagtattccacggtatttatgtgtcacattttctttatccaatccacttttgatgtgcacccagagggcataattttaagtgattgcctagtttccattatatagatatattttaaaaaatttatcacttttggtattatttcctcttatacagtgttatagataatgcttcttaaaaacataattaaatttgtaattttaatggaaatagagttgcttgaataagggagaacatataacactaaatgcctaatgttcctgaagatatatttcaccaaagtgtaatttcaacagcagcacatggtgatgctgatttttcaatactttatcaattatgaccattattatcttaaagtagcttccattttattaataaacactttagcaatgttttagttttcttttaaagtgtgagtttatatattttattattaaaaatgtgatttaaaaacagagtccatcacatagaatattctttcatacaataagattttttaaaaggtttgaagaatactgttctggcccacattaccttctattaggctggtgcaaatgtaattgtggctttgccattactttcaatggcaaaaaccgcgattatttttgcaccaacctactaactggtctctttttcctcaaggcaatctattctccatgcttttgctactcagagtcggggccagcactgtctggacttgtgcagatgctcagcctccacccaaggctgactgaatttgaatctgcatttcgttaacattcccaggtgattctatcacttcaaagtttgagaagcacccatctgatgggttcccagaacgattttttaaagtataaataaagagatgtctctaattggcaaacatgcttcaatggctttctattgctcctggaataaaatgcaaatttaggctgtggcatacaaagatctgtatcattcaaacctcccctgtcccttcagctttaaactcttttttcctggctttctatgcagcaaaaacactgacctcctttcagatttctgaacttgccatgtcctttccacatttagtctaactctctcaatcatctgcagtgctcttaccctaaatcttggtgagcctgactcattttcattcctcaggtctcagctcaaataccactgctatagagaaaacctgctgacttctgctgatcatcctgactaatgtggccatcatggcttttcccctaactctattacaacacccttgttatatttcattacggtaataatcataatgtgcagttatattgttggtctacgtgtttattgtcaatgtgtttattgtctatatctccacctaggatacaggctttacgaggtcagaggtattgtttgtttagtggacagctttattcttagtgcttagaataatgactggcctataatagtcagtcaaaaaaatattcactaaatgataaatggatggatgttatttggccctcctctttccttttttccttcctctcagtctcaccctagcaactttgacctctttttgtgttctctctgcttcattatgtggggcagctcagttctttctcacccttgctcccagactcaaaacccagcctttctgtgctcagtgaactctggtcaaatagttagatccattcagggtctcagcctttcctcactaaagtgacctcactttatcagatgtgatctgaagcacttagtcaactctaaaggctagtaacacatgatgaaatatctaaatgaagaaaaaaacacttaaaacattttagaaagtataaaagtaacttctcaagtccaataattatgagctgaagtcaaagttataattcaaattactgtaagagtaaatgcccctcaggaaacaaattcaaataaatagccttggtagacgtgttgtagatcagatttttaaaagatctggtttaaagatatttacgttcaaaggactggttcataattaccctgcttttgaccatctgtgtagtggctattaggcttctcaaaagattaatagtcatttgagttggtaacactaatttcccagaaggagtctttatttcattaaagtatattataaaattgctcaagcattttattggaagtgatggttaattacctatggggctatatacattacatccttcaaaaaaaggtctcttccagactagtttggagaaacttatctttctcacatgtagttcaagcctttactatagtagagaagggtgttatcagttcttggttttttttccctcttcctgcaagctaataagtgtgttgtttcatccaggttttcagtaaagacatgagactccttagtcagagacaaaggattttgttacttatggcacagcaaacagcctaaacattagtaagttcacttcagttactctttccttaagtccccaaaagatgatacagtgagtgctgatgagtagtttgcatgcagtggtgctgtgtcatagatgaggaactctgagcctgggaaatttatagcaacagtaaacagtaagccagcttgctctttgtcgtacagggagtcattaactcatcccttaaggttgattgctgcaagcctaactctgaaaagtggtcctggtagggaggtcatggctttacactattggcatacccagcaggtcatgtaggggtacaagagactcatagtggactgtctttcaacactatccactccatggtcttatgtcatgttagctgctggaaatttttcttatgagtattccactccatcagtcattctgattaatttgactagagaggtagagagtaaacgcatagaatttgtcttacacaagatttaattaaggctactgtcagtagaactctaagcatgaagaggagaccaacctgcaatagcaacctcaatcatgcctcataggatcctagattctcccagctgtgaataagtcccaaagtacagacagctaggatatagtgtattatttaatatgacctacacatggaaatttagactgacatgctgatctttgttttaattgccaaaaagttaactattattcccaatatagagatctcctatggtccctattccccagacataaacataaccaaaggtgccgaaattaatccagtttgaaatttattgctacactttatttgggtcagcattagttcactttggttaggctatatgagcagggtcagtgagtatttgaaacttctgtaggcattcatggtataacccaagacagtccagacaccaggggaaaaatacacgtttgtatgaatcagattgagaaaatgttgtgctgattcctgtgttttcacacttaagaggatggggaatctgtattgggaagctgccattcatgttgtagaaatgttcaggagaggccatattcacaggagtttttctgttttcatggaatgtggaaggagatgacaaaccaacacacaaccaaactatatggttgccttgccaggctgtgtgcttcatctagcatacaaagagagcattaatcctcactcgcttcacctccagtggtccaagattttcccttcctaggtgtcagtgttgttgctctttttatccacaatcacaaaatttgttcatcccattctagtagctaaagctttgcctttattgtggtcggttcctagtcatactcaaactttttgtctagaacaataaatagaggaaaaaggtattttatgacatttatatatacccattttatttattacctgggccctcgtggaccattgtacaataattcctagagcagaacactcaaattaatgatagttaacctcataatatatgaccatgtttgtccaacaaaagaatccaggtggctgaaccagaattcagttttaataccattctgaccatgttgctaccaggacagtaaacctaccaggctgttctaaggttgctgttaggagaaaaaaagaagcatcatgccttccacttctagaaagttagagaaggtatactttttttccattcatctcgttacatacagctaatgattctggatattacagatgttccttgacttacaatgggattgcttccccctaaatgcattataagttgaaaacactgtaagtaaaaagtacatttaatacacctagtatgctgaacaacataacttagcctagcctatcttagatgtgctcagaacacttacagtagcctatggttgggcaaaatcatccctaacaaagcctattttataatgaagtgttgaatatctcatgtaatttattgaatactgtaccaaaagggaaaaacagaatagttgtatatgtacataaagttcagtttctactgattgtgtactgctttcataccactgaaaaattataattcaaaccatcataatctgtgcataagataaaaaaattaaaagattctaaaaagtggggagaaaaagcccaactggttaagaaatttcagaaacgctaaagcagtgagttccatgagtttccttttgcctcatacaatcaggagtagccactgacctggaaatgttagtgaatatgtacaaaaaagcccaaagaccaggcttttgctttctttagccaaaaaaccaggagaataacagactgtcaagacacaaaactgaaagactataaccagtttactccagccaaataccacagaaagatttacagctaccaagcacatctttagtcaataaaaaagtagttgcaacctggtaggagaatttgtgttatttttaacttacctttgctccatctcctcatcactggctttaagacagtctttaaattacatcctccattccaagtatgggttcctggtgctagaagaagcagagtggaccttgttatatcaaagtagtgcttgattactttgacctctccagtggctcattgaagggctaattcaaagggcttgcctgtgtttcacacaactcaaaatcccctcagggtggagaattggctacagagaaaagtttttttctaaaaaacaatttgctaaagggacttaacagcaggtaggagaaagaatctacaaatgtgaagataagccaaataaaattattcagtctaagaagcagaaggaaaaaagaatgaaaaaatatatacctaagagcttaaatgacctgtgggacattaacaatagcacagacataagtataacagaattcccagaatgggaggagtgacagaaagattcaggaaaaatatttgtgatatgatgaccctaaactccccaaatttgatagaagacatggatctacacatccaagaagttcaaaaaggactaagtagaatgaaggcaaaaaaattcacagtgagacatattatgatcaaattgtttaaagaaaaagacaaattgagaacttgaaagctgcaagagagaagtgagtagccacatgcaagagatccttaataagattagcagtcaattgttcatcagaaaccatggaagccagaaggcagtaggatggtataaagtgtttaaagaaaaaagttgtcaaccaccaatttatatctggtaaaactattgttctaaaacaaaggagaaattaaaacagccccagataaacaaaaactgagtgtattcatcacttgcagacctgctctatgagaaaatctaaagggaatctttcagacagaaaagaaatgacactagacacttggagccatacaaaataatgaacaatgatgaaggtaattacataaataagaataaatgccaatatttttgtagtttttgtttataactcccattttcccctaaattatttaacaaactagtggataaataataattatagatacatattaataggagcacaatgggtaaagatgcttgtgtttttgcaggtgtataaaaatctcctttgttgtttttcatagtacaacttctgtatttcaaatgaacacaaaattagtagcatttgcagtagtatcttaaaataaattgcctttgaataaaatcttgctttccaatactttgaggtccacgagacatttctagaaaattttatgccatggaaaatgaagaccacttaatccagtggagaaggggagtgtgatttctctttgattgattgccataacactgtccttaaggcatatgaaggagagttctatatgtcatctagacattattaggcacagaagctttttcagtacaactttgatgttatgtaaagtgtgtcatcttgctagcactgatatcgctcttgggtacaacattagatctattgacccatactatttttgttacaaatattcaaaaggtgatttttttctacaaggactgtgcttcaactccacattcaattttaaaagttatatatttttttaaataaattttccaagactgtggcgactgccatcttgggttgctccttctttggtttttacagttactgagaaatggcttttgtgatttctgccacttgcaacgtactcttagagaaagggatttcgatattagtatattctctttcattctatttcctatgaagttgttggtgggaatagaaaagacctgcccaagccatcattgatggatactggctacatggtccttgagtagaaaagagcctgcatccttcatggcctccagccacaagcttctgcaaggaaacaaagcatgttatgaacaagaggaggaacagtagttgtttgtgcttctttctctgtagacacaattaagtttcttgcatagataacccttcatagatctgattttctgtttaggttgagatggaaaggcagaaagagacaccaaatttataacttttggaaattaatttgaagatatgagctttttacaagaaaggcaacgagagaaactagaaaaataaacagtcacacaagatgtcattgaaagtctatgtactacttcctaaacatactttgtgtactcacttcccaagggtaagatgggtactgcacacagaggcagcccaccctaagggaaggatcatgggaaaggggaaagcctataaagctctagggtcaaggttaaacactgcgctttacctcagtgccgggcttggctctcttccaagtgtaccttcctttctttcctattctaaagccttttaaaataaatttccacccttgctctgaaaaaaaaaaaaaaagaaaggctatgtactgaaggcaggtttatctctattataccaacccatgtaagtactgttttgacatgcatgtgtcattggtgcaagatgcaatggctattcccaagcccctctattccctggtcttgttaaaaaatgttgctaaggctgtgagctagaaccatgcttgttaagctagattttaggtcattctgttttgaaagaattattttgaattacaagaaacttctttaaaaattggagataacagaatggtatagggatgtgtggcctgacatgaagagctatgcaatgtgaaatgctccttgaattgcaagaatctcacctaaatttttataatagaatacttcatgactgttatttcagtgtaggaaagtggctattagaaacaactgctcttactcatacaacaattgccatttgatatcatacacatacacacataaacatccccacagacattaacttggagcatttgcttctcaaatttttaactgatgtgtcagatttttaaagtgacttgtttacataataaggctctacattttgagtatatgtttgatcactatcatgattccacaagatggcagtgtgttcttagggaccttgaggacagctctcaagtgctcgtgtgtgtgtgtgtgtgtgtgtgtgtgtgtgtgtgtgtgtgagagagagagagagaggaggaggaggaggaggaggaaggatgaggggaggggcttagtggtgaattaggggtgttaaaaagagcatcatttttttgaactggtaaagcagattctttttatgatttttaaagtagaaatatccattctaggtgcattttttaagggtttaaaatttgaatcctcagtgaaccagggcagagaagaatgatgaaatccttgagagttttactagtgatcctgtggcttcagttgagctgtgagtttggggcatctttatataggaaaataatgtacagtatctggagttactgtctattctagatctataggtagaagcatgattttttttctaactaagggaaagtaggggcaccagtgaaaagaggatttaaattctggggagtaagcatctattacccagccagtcttctctgtctgaccactgtctttttcacaggggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacacacagtgctccccagacacctgcagtctgtacccaaacctgccatgccccaggaatgcctgatgtagagcttagactgcagggtagtgaaactccccttgctctctagtttcaagtggaaattataagaaccagtatggaggattaattaattagggaagtattttcataattctgaaaataattgaaaccctgaaaaaaataaaaacaaaaatcttggtctggttgacatattttttagtcctgtttttccactatagttttaaatatttttttaattgaggtctgactgataaacaaaaaagtatgtgtatttactttatacatacagcacaaactatgccataacatatccataatttctaaaagtttacttcctccctccttttttaaaaattgaggtatgattgctatataaaaaggcacacatatttaatgtatacatcccgatgctcagtctagttttatgccacctctttatgagattggttttatggtttttaaattacataacaagaaaatattttcacacaatgacagatattctctcatagttcccaggacaccttcgtctttccttctttagttactcaaagtgtttgaaagtcattaatttgggaatgcaacagcaaaacaggaatgcaaagcagagaaaaactcacaaacaaatgacttcaaaaattctacaagtcaaaaattctttttttttttttttttgagatggagtctggctctgtcgcccaggctggagtgcagtggcgcgatctgggctcactgtaagctccgccttccaggttcacgccattctcctgtcccagcctcccgagtagctgggaatacaggcgcctgccaccacaccggccaccatgcccggctaatgttttgtatttttttttttagtagaaacgtggtttcaccgtgttagccaggatggtctcgatctcttgacctcgtgatctgcccgcctcagcctcccaaagtgctgggattacaggtgtgagccaccacccccagccaaaaattcttttaattatagaaacctcacctcatctccagcctcagccacagcactactcctgatttatgtaagggtatatttcatggatagatggaagaactacagtcagagggtaagacctggttaaaactagaagtctagatagttgcagtgactaaatattagaaaaggtctatgttgccattttggggtaaagtctgaactgaactcaaaactcctggcttgagccttgtaaaagaatatattaatacctttgtacttaagtgtggcttggagatgatagggagcattagccctagccacagcatgccatatctccagtcagggcatgggagcatggaacaatctaaaattcattgagaaggatctctgagtaagtatcttaaagaggtccagacactaaggggttttagtataatgagcaaagacctgtgtgaatcaattcccaaagactatatggtattgagaatgtttcagcaaattttcgtcaggagagttggaaatgctgaacagcatataaatgcctccctccgctgactacctggcattatagatttgtcctgcaatgtatgccaagtccacgaaaaatatttacttcctaatgaaaataatgccatttaatatttagtacattgagttataggaaaaagcttgaaaagtgacatttattgtaaaaccgaatttgtggactgttagtcatgacattgtttaggtagtacaggaggtggaaaaattttggaaatgaagaatcaagatttctattcagttagttcacgtagttactgatgaaagatgcaagccaatcaacagttgcttcaaactgttaatttacagaactgaagatttaagaaatttttccaagtcatgtaagatttgtaaggcagtgaggatgatcagaaagttgtactgaaataaaaatacttaaattttagtgccacttttatcatatgccttcaggcaccctggcactctggaaagaccctgggctgccatgctcgtttgaatatcaattatgttgctaacaggccgtttatattaagctgtactattatatatatttcaggtttggatttaggattaaatgagatgaaatattgtcttgggataagttcattagaagcagagcctgaattggaaattctttatccataattgattgagaaaaccgggtcgagatgggaaaaggctaagcataaacgtgccagctagtggagtctttatccaccctgacctcatgggagctctggagcatgaattgcatcacaggattgatcctttccacactgaggcaagggggccagaatgctgacctattgtacgtaagaataaagtcgtcattggctgtggtgtttcttggggtagaggtatactctactggacaatgatgactctcattggcagaggtcgattttctagggaaaggggcaactgtgagctgagagtagccaacattcccaacagtaatagcgacaggagacagacaaattcctacgcagacatggacagatccccggtgaaacccggccttcaagccaaggacagttcaaagccttaaaaccgatctgccagttctggatagaatacatagccagagtgagaacttgaatccccactcttgcccactctctcgattggttccttctggatgatgccttttaaccaatcaaatggtgctttttccaagaccacctatggaccaatcagcatgcactcccccattctaagcccataaaaacactcggccttagcctcacagagggctacacactttgggtcccgtcttgcttaccagaggtttcctgtcactcagtaaaattctcctctgccttgctcactctttggtgtctgtgtacctcattcctcttggccagtgggacaagaatctggaatccaccgaactgtgggagtgaaaagagctgtaacaccctctcccactcgctgaactacgggagtggaaaagcctctggatgccatttcctcctgctctccgaactacaggaagaaaaaagccatgacagtagctggggatggcgacactgtcctgggaaaggggatcttggctgggcacaagcagtgttcactattaacatggaactcacctggcatatgggcagcattcaagaaataatagactttgtaattatattctgaattttaatttcattctccatttgaaggagtttatatagctggctttcccgatcttgaagagttgaaataatgttaggttaaagcacttcttcttcttcttttttttttttttttttgcactaatcacatgtagtgattttattttttatatatttttatttttttctttatttcttctaaaaaaaaacaggatacatgtgcagaacatgcagtttgttacatatgtatacatgtgtcatggtggtttcctgcacctattgaccggtcttctatgttccctcaggctaaagcacttcttaacagaaagcatctaaataaaggtaaagaaatattattcaaagctaaaactcaagatattttaagaataatgactaaggaaccactatgttatcttacttccttttgagaatgattacatgacattctgttcatcactttgtattgaggtagaaatgactctgatgattcacagttcatgactctgggcttccatgtatagagacaacaacagaaagagatcccatctatacttatacatgattaatgctattttgttattaatttgtatttaagaatggaggactgggtaacaggatggactcttcatgtcactgtgcccatgttccccacaaggtttcttctggaatggggtgcctggccagtagtgtgggtatgtgggcatatcatgtgatttggcaggcttctttttaggatgaatgaacagggaagtggtaattaagttgctcctctttgttccttgcacctaatatcattgaagatggcctaattctgtcaaccactcataataaaactgcagtaatcccagcggttcatttaaactcttgtgaaaattaaatacccaagtaaaagttggcttactatgcctatcacacacaagtacagaagcaggatggtgagaacggagggaggctagtgtagctattccatgtgtggaccttcagtatgttctcttgtgttctgttcttcccactctccatcacctactttctttctcaacccggaacctctccagggtctcacccagtaggttcccttcacttgcatttccactgcaatcttctcatagttcattctgggctggacttctcccccttctctgtttcatccatcagtgtgctcacatctacttttcatttcatgggaattgtgatagctttcatcttttcattattacttttaccattatggattcaagtcattctttttatacttctaaattttatttcagtgggaatattggaaagataagacgagaatacatatgcttcttaggaattttgaatcagaagcacatcctagtaacatttaaatgttcaaactggctatatgattttgtcttacacataaaaaatctataggcagaatcaaggaatagatcagaagtgcaagggagaactgatttcaggctggcgtgagtgaacagagtacacagaaaggagggattttgttctgaccttgtgaaaagaatccttgttggccaggttctcatttcacctgagatttctctcctcatttggttttttaagttttagggtccaatgatctctatgctaaaataagttggatgaagatggcttcttattcaagagtttcatctttttaggccagaggcgaccgctccagttcaatacagcctatctcccactcacaggggactactgcttgcctagctctgttgagtatcactgtcaatctctcccagattttctatacctcccacaaggtcctctcatttcttgtctgctggttgcattcctcccaattttctgagttaacacaggtttattttacttttcttttcctaactcttcccaggattatttatttgttatattttcttacactcatcattccactcaagtttttccatagatgggcctctgttaatgttctttttagtgtgagatataatttggcatgatgtatcagactgtaggagctttgacaattggaacatgattctttttaaacatgaagtacctaagttgttttttcctagagttacaaatatcgaagttattgacctgaaaccaaggggcctctttaacatttttgcttaacaaaaaaaattttgctttatttgtttgctttgattaattaattagtgacatgtgatccatgctgattttaagtatgagactcaggtctagtttgtttatttttttaagaatcaaataaggaataatctctttcacccaccgtaatgctgacattcagaaacacagggccatatgaaactcagcccagactgaggcaactgatcacctcccttctccttgatgaatggttttacaaaataatatagagtgtctcaatggtattccaaagtctagaatgttgtcttctgtgactagttgctcagtaaagtaaattagtcttctatttttacattactctcatttctcatgtatttaggattaaaaccatgtactctacagaaggtgacgtcatcacagatttgggaagaaagaaacactttctgttggttttgataccacatttctcaaatgagaagcaaacagttcacttccttggatccgtggtttcgcctgtggccttcagggggcgacgttgcactaaggaggcatctgtgttcattgccgaccatcctcatccactgagcctcctccctgcagctggctgatgtagctcactggtgtctgtgtagatagggagctgtgatgagaacaagaggtcagaacacatccaggctccttaagagaaagcctttctttaaccatttttgaaacccttcaaaggcagagacttgtccagcctaacctgcctgctgctcctagctcctgaggctcagggcccttggcttctgtccgctctgctcagggccctccagcgtggccactgctcagccatgctcctgctgctcgtcccagtgctcgaggtgatttttaccctgggttagtaacattccattacctttcttccttttgtaaatgtgactgtgttgtaattttttctgaatagagacatcttttcttcatagcaaagtctgtgctgcctttacttacacagcattggtgttgcaggaggaaccagagcccagtcggtgacccagcttggcagccacgtctctgtctctgaaggagccctggttctgctgaggtgcaactactcatcgtctgttccaccatatctcttctggtatgtgcaataccccaaccaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgctgtgagtgacacagtgcttgagactgcaggagaggtgaacataaacctcctgagatgctgagactttctgtgactcaagaactcaaccttgaagtctgttttataatattaaatagcatttccaagtttctgatgcttattgatgtatgctgtatctttttcatctatttatttttaaactatctgtgactttaaagtgtgtttcctgtaggtagcataaaagaccatcttttctttttatctactttgttaatctctgtttttgcattgtgaagtttagataattaaaatggaatataaatatcaatcaggttggatttaagtatacttcattattgtgtttcacccatgttcctttttttgttctttttttctgactccttttggattatttaaatacttttcaatttacattttaatttatttatgaactttttggctataactctgtactttttgagtagttgctctgaagatggcaatgtacatgcctaaatatccagggtcttatgtgagcaaatactgtacctccttatgtgaaatgtcaaaatcttacacaacgtctctttatctaccaacactaaagtttgttattgttgttcatatatattagtcacatacattgaaaacttcaccaggcctggcacagtggctcatgtttgtaatcccaacactttgggaggcagagatgggaggattgcttgaactcaggggtttcagaccatcctgaaacaaagtgagacccccatctctatgaaatataaaaaaaatagctgggtatgatggcactcatctgtagcctcaactactcggcaggttgaagcattatgatagcttgagcccaggagttcgaggctgcagttagctaccatcatgccactgtattccagcttaagcaatagagcgagatccttgtctcaatttttttttttaaaaatcacaatatatagaaaacttcaccatataatgttataatttttgctttcaacaattatatgcactttataaaatttaaggggaagaataagaactattttatacttaacagctatttatcatttctggtatccttcctttgttcctgaagatctggattttctctgataccaggggatataactgaaattcccttcaaacttaaaaactccctttagcatttcttctagagcagatttgctgggaaacatatttttcatttgttcattacctgaaaatgtatttttaacttgccttttatttctggaagatagtttttactgggtctgtaattctgtgtcaacccttccacccctcccgctttaaagataccatttcattgtcttttggcctccatgctttctaatagaaatccattgccattcaagtaattgtccttcaatgatgtaatatattgtttttctctagctgcttcatatataagctatgtacacacatacacacacacacacacacacaaacacatgaaaaattatacaatcttttgttgtcagtggtttaatcataatgtgtttaggtgtggttctctttgattttaccttgtttggggcttgaattgataaatgtatgtctttcgagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagtttaccaactaaaaagagtccaggaccagatggattcacagccgaattctaccagaggtacaaggaggaactggtaccattccttctgaaactattccaatcaatagaaaaagagggaatcctccctaaatcattttatgaggccagcatcattctgataccaaagccgggcagagacacaaccaaaaaagagaattttagaccaatatccttgatgaacattgatgcaaaaatcctcgataaaatactggcaaaacgaatccagcagcacatcaaaaagcttatccaccatgatcaagtgggcttcatccctgggatgcaaggctggttcaatatacgcaaatcaataagtgtaatccagcatataaacagagccaaagacaaaaaccacatgattatctcaatagatgcagaaaaagcctttgacaaaattcaataacgcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcgccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagctacttcagcaaagtctcaggatacaaaatcaatgtacaaaaatcacaagcattcttatacaccaataacagacaaacagagagccaaatcatgagtgaactcccattcacaattgcttcaaagagaataaaatacctaggactccaacttacaagggatgtgaaggacctcttcaaggagaactacaaaccactgctcaaggaaataaaagaggatacaaacaaatggaagaacattccgtgctcatggataggaagaatcaatattgtgaaaatggccatactgcccaaggtaatttatagattcaatgccatccccatcaagctaccaatgactttcttcacagaattggaaaaaactactttaaagttcatatggaaccaaaaaagagcccgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctaatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagttctaaaaccataaaaaccctagaagaaaacctaggcagtaccattcaggacataggcatgggcaaggacttcatgtctaaaacaccaaaagcaatggcaacaaaagccagaattgacaaatgggatctaatgaaactaaagagcttctgcacagcaaaataaactgtcatcagagtgaacaggcaacctaaaaaatgggagaaaattttcgcaacctactcgtctgacaaagggctaatatccagaatctataatgaactcaaacaaatttacaggaaaaaaacaaacaaccccatcaaaaagtgggcgaaggacatgaacagacacttctcaaaagaagatatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggtgattcctcagggatctagaactagaaataccatttgacccagccatcccattactgggtatatatccaaaggactataaatcatgctgctataaagacacatgcacacatatgtttattgcggcattattcacaatagcaaagacttggaaccaacccaaatgtccaacaatgatagactggattaagaaaatgtggcacatatacaccatagaatactatgcagccataaaaaaggatgagttcatgtcctttgtagggacatggatgaaattggaaatcatcattctcagtaaactatcacaagaacaaaaaaccaaacaccacatattctcactcataggtgggaactgaacaatgagatcacatggtcacaggaaggggaatatcacactctgggaactgtggtggggtggggggaggggggagggatagcattgggagagatacctaatgttagatgacaagttagtgggtgcagtacaccagcatggcacgtgtatacatatgtgactaacctgcacaatgtgcacatgtaccctaaaacttaaagtataataataaaaaaaagataaatgtatgtctttcactgaatttggcaagcttttggccattctttcttcaaatatgttttctgacccaatatctttcttctctccctctaggactccagttagatataacttagactttcgaatattttcccacaggtctccagggctctgcctttttttctttcaattttcaaattgattttaaggtttgtcagtgtttcctgaccttggcactactgacattttggtcctcataattttttattggggtgtggggctgccctgtgtgttgtagaatttttaacaacaccactggcttctccacactagatgcctgtagcactacataccccaagttgtgaaggccaaaattgtgtccagatttgccaaatgtctcctgggggaagacaaagtcaaaattaattggattaaataatctgtattgatctttttcaattttgcatatgctttcctctatcattttgctactgagcccttactgtaagatttttatttttgatattgtatttttctgttcaatttctatttttttctttactttgtggaacataatcaaaagagctactttgacatctttttctatgagttttagtatcttagtcatcttggtatttgaatttgttgatcttttacttaaatattagttcatttttctggccctttgtcaaataattttgaagtacatcttaaacatttcaaatattatgtgtgtacactctgttttctcctcctcttccttcttcttctttaaaaaacaatcatctaaagaatgttaatgtttttatttgaggagaaaatcaacctagtttggtttatactactagttgtgtctccccttttgtggaatttggtagctcaaaatcacagttcagttctctaatcatttgccatgttggtttgggtttatacctgtcgtgtgtagctcagggattagtgaaaccagtttgcatggctcaaatctcaggtcagttcctgaactctctgctacattggttttagtttgtcctgcatgggtgccacttgggggtagtctgagactggaatagtggttcaaatatcagttaagtaacctaaaatttgttgttctggtttgagtcagtttcacgtatgtagagccttgggattagcctgagacttaaactattttccatctcttccctagggtctcccttttctagcctgacccacagaggcagaaaattgtgtttcttgcagagttttgacttcctacaccattatcatattgctgtgtgcattggggcctccctcagggcaaagccaagagaaagaaacagaaaaaatatgaaattcacccttgtgcaggttgtttctccaatttttgacttccctacacaatctgctagcttttgggtaatttcagagtccacaggtagtttctttttttaaatttttttattgtttatttattttttattttgttcagtttttacttacaatccatggcagagattggccgtaggtatcttaaagttatctcctattctactgtggtcctgcattaatttgtggttctcgataatattaatcaagaatggctatttggcgtgtgcttttaccaccatctttagttgtattaccctttttagttaatctaattcattttttatatttgcaaatttttctcatcaagattataagaccatttaattaagctcttaaatttttttgatatttcatttcttattttccaaatttatgaaggtctttctttggtgcaaaagaattgagaatgcatacttgtttttataaataattcaagtactatattttttcctaaagtctaaaaatttttgtattctgaattatatctggatttaagagtatgttaaggcatagtaggactattcaaacactattttttttagtacataaaacagagctgattagtttttaattttctctatttttttcatttctgactttttgcttcttttaaatgaaacatgtattttggtatttggggctgtgtttggagacccttaaatcttccgggaaatcatgtatttcttagaatgctgccaacacccttaagtgagaatattctatttatgatcttattcttatttaactaagaggtgttgcttctactactatagaggattgaagaattcctttacattcttccagtgcagagcaaaaggcaatgttccaagacatcacacaatcctatggcctttgactttgaacatactgggctttgcaaatgctcagcaactttgagaaaagttaaaatgaccaccattctgaaattcagaaggagttgctccttatagcttattttccaattttttttctgctctgactttaatcttcaatatgatcccacctactttctgtgtcctagaaatatgtgtcaccctttcctcaccagatgaccttcattttttttttactcttgtgaattttagtctatttccattttatttctattctttaatttaggaagaaatattcaagagaagggaaatgagcatatagcattaggattagaagttcacactcaaaggctacacttttacaaaatgacagcattactcaattttcttcattcaagaaaatcttttccaacaggaacaaatgaatcaagaacccaaggagagaactgggcttatgctttcaaatcaaaggaaagaagtattctgactttgtcaagggtcccattagccacagagaaagcagtgactttctgcattctcgtgttttcagagttttatttttttccccatgcactatctacatttattattatttgtttttatttttaaatttcaacttttatttctcgcttggtgtggttgtatttccttcagccccacaggtgtctgtagttttattttctttacccctagaggcaaagccttcccatcatgagttacgccttgtcattagttgcatggaggcactactctccttatgtgaaatcttttcctctatggctgcacaagcatcatccgagggaaatatctctaccatcctccatcagcactgtggcaacactgaaccatccaaaactcagtccagggcaattggtctgaacccaaactctcatggactcatatctaaattctgatatgcttttcaataacgattcctcttgatgtattactccatctttacatgaaatcttattgctaatggactctaggactaaaacaccatcatagatttggtcaggaagaaacacgtcttgtggaagttttgatacatctcagaaaacaggaagaacacactaatgaacagtctgtgctaaactctggttctgcacttggcctccagagagcgatgctgcacacactggagcttttgtttctgttgaagatcagtccactgctcagtttcttcttcctgcagctggttgagttctttccagacaaagacaagtgacaagaatcagagttttaaaagcaaccagattcatctctgcagcttttgtagttttatataaacaaagagcttgtccagcaaaccttccccacacttcttgttcttggtctcttcagccgctttccttcctgttctctggagatcttgcagaaaagagcctgcagtgtttccattgctcagccatgctcctggtgctcatcccactgctggggatacattttgtcctgagtgagtaaaatttctttatcatctctagttccacaggttctgactagaaatgcttgctttttatactgagtctgcactgctttcactgatagtacattactttttcaggaactgtcagagcccagtcagtgacccagcctgacatccgcatcactgtctctgaaggagcctcactggagttgagatgtaactattcctatggggcgatgttgtgggaagtcagggaccccaaacggagggaccggctgaagccatggcagaagaatgtggattgtgaagatttcatggacatttattagttccccaaattaatacttttataatttcttatgcctctctttactgcaatctctaaacataaattgtaaagatttcatggacacttatcacttccccaatcaatacccctgtgatttcctatgcctgtctttactttaatctcttaatcctgtcagctgaggaggatgtatgtcacctcaggaccctgtgataattgtgttaactgcacaaattatagagcatgtgtgttcaaacaatatgaaatctgggcaccttgaaaaaagaacaggataacagcaatgttcagggaataagagagataaccttaaactctgactgccagtgagccaggcggaacagagccatatttctcttctttcaaaagcaaatgggagaaatatggctgaattctttttctcagcaaggaacatccctggggaagagaatacgtgcctgggggtgggtctatagacggcccccttgggtgtggccatcttctatagtcaaaactgtaggggtgaaataaatcccagtctcccatagcactcccaggcttattaggaagaggaaattcccacctaataaattttggtcagactggctgctctcaaaaccctgtctcctgataagatgttatcaatgacaatggtgcccgaaacttcattagcaattttaatttcgccccagtcctgtggtcctgtgatctcgccctgcctccatttgccttgtgatattctattaccttgtgaagtacatgatctctgtgacccacacctattcatacactccctccccttttgaaaatcagtaataaaaacttgctggttttgcggcttgtggggcatcacggaacctaccgacatgtgatttctcccccggactcccagctttaaaatttctctcttttgtactctgtccctttatttctcaagccagccaaaacttagggaaaatagaaaagaacctatgtgactatcggggcaggttccccaatacggcaacaccttctctcttctggcatgtccagtcccccggccaaggcctccagctgctcctaaagtacttttcaggagacactctggttcaaggcattgaaggctttgaagctgaatttaagaggagtcaatcttccttcaacctgaggagaccctctgtgcattggagtgatgctgctgagtacttctgtgctgcaggtaccacagtgcctgggtctgcaggggagctgaacacaaactgcctatgctagagaagttttcagagactcaatgtatcttcctgtggcattttcaaagatctcttatttttatgatggtgagtgaggcaaagagagctgagcacatccagccatttctatataattctgcaattcctgctatgtcccatgtcagataaactttgttttagaagctttttgttaattgaagaaactgcataataggaaatagtattctagaatgatggaggagacatacttcttatcacctaacaatcaggttctcaaggacctttccttgactgtgactgcattaagtggttgactatgggaattttgatatggtctaggagaaccttggttttcatttatcatttaatctctcaactaacccagaaaacaaaacataagtttctcatgttcttaccttgcaagttgcatccttgagctggtcattcacaggatattttcttagaatttatttttctggctctaactgcgcaattcagatttcaggatattttgtctcatacctctatttaggaggaattatgagaaattgttagctaacagtgaaagtttcattagaatcacgaaggacttagaaaattgtcacagtgatgtgagttctggcaactaggaatagcacacaaggagaatgaagatttagaattcatcagtgtttctccaaagactttttcagttataaaaatagcttctattctattggtatattaattatgcaaatctacattgtaagtttgtctatggaattccattcatctcttctagctactgacacttttacttgttgctttcactctgttgttacatggtttcactattgaaatattaaagattgattctcttttttgagatagagttttactctttcacctaggctggaatgcagtggcatgatcatagctcactgcagccttgacccatgcccccaggctcaagcaattctcccacctcagtcagcttcctgagtagctgagactacaggtgtgcaccaccatgcctggctaattttttttttaatttttatttttagtggagacaagatctcactatgttgcccaggctggtttcaaactcctgagctcaagcaatcctgcaacctcagccccccaaagtactaggattacaagcatgagccactgtacctggccaaagattgattcttatatagtaacattttgataatctgtcatgtggtaagttttgcaatgccaagctctgctagaaatacggataagagttacaatggtactggattccaggcggctgctggaaagtataaatatgtgactttcttatgtctagaatggaaagaactgtataagaagattttatactccttgtctgcttgctgcctcggaggataaccagtgcttcggaggaaaagtagaaggagaaggagagagctctttagctgccatttagctcacactataaatgtctaagagggtaggtgcatagggaccctgaaaatatagatcgaataagtaaattgtggccaatggcactccttagccaaatagtgaaccaagatatcaacagtattttttaggatgtagtgttatgagtacatgtgataaatatgtttaagcgatttctggaatgctgtgaggaaggtgaatggagtgtcagatatataaaattatgaaaaagaaatgtatgctcatttaatgttcctgcctcagtcccttccttcttttctgtttttggaccacactctcatctaccactgataaggcaaataatttcaagtgactcattgtcatcagctcagccacactgcccaaaggtacttgtcatagtatcatgagcacttcatgcagatcgatttgagaaagaactgcccgtttcttttgattctgatctcaaactgaatattaaagaaaaataaattccataccaaggaccctgagcagctgggagagcattccccatctcccctacctcacctctgcctgaaaaatcaaagtaatcttccttccttctattaataatttgttgcttttatatgagtacgtgatttgtaggagaaactttccaaaataaggaattatattaagaaagtggagattctgagttattttatcaatgatatcaatcattctgacttttcagaaagaattctgacttttcatgaaattaactgatcttaccacatattccatcaccgagaagcagctgccctaattgaaaggcggaacactttactgaagaccaagctagagccctgactgggagacaacagcatgtatgctaaacattttcttctctccctacatcgtattttttatctgatatacaagctgttggaaacaaactttataatttagtgtaaaggtaacagaattttcaggctgggtgaggtggctcacagctgtaatttcagcacggtgggaggtttaggtaggaggatcacttgaggcaaggatttcaagaccagcctgggcaacatagcaagaccacatctctacaaacaattaaaaaaattagccaggcatggtggtgcccacctgtagtcctagctactcaggaggattgcgtgggcccaggagttcaaagttacactgagctgtgatcatgacactgccctctagcctggatgccagagcaagatcctgcttttaaaaaaaacttaggaaggactgtcactgaatttgaagaattattaatataatcagtgatgaagtcaatgacttttgggattgtgcatcttctcattttggagaaaggatgaaaagttcttcagttgcaagatggagttctgtatcttgaaggagatagaggaatagaattattttgttgttgtacatgtttcaaatgtttgtagaagaatgtgtgtgttgcatagggaagcttgaagtagttgaaggtatcgatttattgactctcagctccaaattcactccttgcctcttctgtgaaggtgaatctggaaccttcgaccatttttctttgccagttgacacaatgttaagctttgtagtagagagtcaggaagaaaaagttttgctttctgctttccatgtgctcactcatcaggatcctgcaccatgggaggcacctgcagtgcacagtgccctgcagtttcctccagaacccccccattttagggcgattctgtgaaagagatcctgcagtgagacacctccctgtgaacagctttccccagtgtcctagaggatgattttctgccatgttctagagggtgaatttctagcaagttctgctgggacagcaccacagcaacttccctttcatccagtgagccacagctgtttcttttcaataagatctgggtctcagccctgagggtggggctacaggcctcttccctggttatcctaccctgccctaggagtagaggctgcaccttatgtctgctattcctacaggaataggaatagcagaatttcttttcttcatattattcattctcttgttactctaatactctgtttattaatccttaaattttttctgttgaaattctatggtttctctttcctgattggactcgacttagacatgcaccaaggacttcaagcaactggagagcatcttccatctccccgcccactcctgcctgagatatcaaagtagttttcttgttttatttctctattgatttgttttgcctgcttattgttttatttacattgttgttatataattatgagaaaattttacaataattttattaagaatttggaaatattgttaatatattaataaaattaattttactattaaaatttttgtgcacattatacacagaatgttattataccattggtgcaaattgaaatcaattttaaaaggtttagcatactgcacaaataggcattaattcacctatgaggatgtgtctggagatcgtaattctaagtcatttttcttgcatgtaactctctcaatacatcattattttttgattttctatttccttcagatggaggaagaagacaatgataattgcaaaactatctgtagacagaatatttctgtcaccccagaaggttttatgtgtgcctttctagtcaactcaccttctggaggcaatagatgttcttatttctatcaccttagatttactttacccattgtagacttcaaatcaatggaatcatacagtagttactcttttgtgcctggtttctttcattcatcgtgttttttagattcccccatgttctcatgtatatcagtcattcattattgctattgctgagtagtatcttattatatgaataaagcacaatttgtttatccattcagctgcgcacaccactgactggacatagaatctttcagggattaaatctttggtatcattcttaagagtgcaaggtacagttgttctagatttttctatcctgtctttcaagggtagggcgtgtctctaaaatacttcagttgaaacatgtatcttaaatacctttatttaaaaaccaatttctatcattcattatggtacctactgtatcattagttttgcaaataaaaacccaacatctaatattccctatgctatttagcaaagctttgggtattatccaagctgtgggtagctgaactgtagtttcctctgttgtggccttacgtattaataacaacagtagctgaccaccctggaatttgctttcctgactaagtcaattgactctccttagagttgagacttaactagtacatatccaatattctctggcttttgtcgaaaagatttaatgtaaattatacatcctaacactgtgatatatttatttttacttggtaactgatagatattatgaacaaaatttagatcattgttcctgcaggtcctgaagatctgtaagtcatgtaattataatccttgctcaacagttattctagagaacttatttaatatttagaggcactttgccctttacagtacatactaaaaccttttaaagcttgttaggtaacttatgaagaaaatttcactaatctattatttaataccaaatatacagcatatacaatacacattttcaatcttttaagcacattaacaaagttctcaggatagttggatctctgtacacagttttttacaggaatatctaagacaagggaatacctttatttaggacacaaatgcgccaaaacatgggtataaaagtagaatgtggccaggcacggtggattatgcctgtaatcccaacactttgagaggctgaagcgagagaatctcttgagtccaggagattgaaaccagcctgagcaacagaatgaaatcccatctctacaaaaagtaaaaaaacatcagctgggcatggtgacacatgtctgtgatcccagttacataggaggctgaggcagggagtattgcttaagcctgggaggtcaaggctgcagtgagccgcaattgcaccactgccctccagtctgggaaacagagtgagaccctgtctcaaaaaaataaataaataaaaataaaaataaaaggtagaatgttaaaatgttgaagatagtttatatgtatatttataacttcatattgttttttgtgatatgtcttatataataggaaaataaaattgacctttatattaatattctaaggctggcataacaaaatatcacagactaggtgacataaacaacataatttattatctcacagttccacaggctagaagcccaagatcaagttgtcagcagggttaatttcttctgaagtttgcagatcatgttgccttttcattgtgtccttacacggtcttgcccctgagggtacgcatgtctgtgtccaaatttacttttcttataagaagagcagtcatattgaattagagtccacttatgtgatgtcattttacattaattatttctttaaagagcctattttcaagcaccattacgttctgaggtactgggggtaagggcttcaacatgtaaattttgggttggatagagctcagtccataacaactctccaagtaaatattacgttcacaaacaagacagttgaaacctttctttgtgcaatgctttactaacttctcgtgcacacaatgatcgtgtataactttgatggagattttcctgtattgagtttctttctagaggaaggagaaatgtgcaattacaaatacagatagcttataagatattctacattgcaaaagaccagtgataaaaattaaaagctgtttttcagacttgccttctttttcctctgctccactggggtgcagaattctctcatgtttagatttgttcttttctgaagataaatcttaatttctccttggtattttatctctgacagttttcctttctttccccattccgttttctgtctgcatgttacttttttttacctctgtcttatcgtttgtctaatattagattctacctgtgcagaagccaatttagctaacttgctgtttttctcctgcactcctcctttaccacctcatcagcagaactgacatttaaaaaagaaaaaagaattgaaattcttttgaagttgtttagggcaagtgaagcgggttaagtggatgaggaaggtggctacagtccttaaacacaggggcagcaggaagaattccatcctatatgctcagctttcttgaggattgttttctgttttttttttcaagtagtatgtatcaatattttaaattttgattcaaccagataatcttttttaaaaaatatatgctttggttgctgacatgcttggattcattttaaatatatttgttttatgcagcattctcttgatttttttcttatttctttttagcctggcttctcttgcattgataaagtttgatttttcttcatactgctttgaaaatgtaatgtgtatttctgttatgataagtacccttgttatataaatgtatgtatagaaatataaaatacatatgaatgtatgtatatatgtgtatgcatatataaatctaatttttatgcccaatgttattcttttttttccctcagtgttattctgtaacattttgcttgtatatcccagtccttctcctttacctcctgctgacttatgaattttagaattaccttcgtggctgattggaagaaactacacataagctatatacatcaggacaataatttcagtaagatattatgaaatgaacaataaactatagctccaatgtacattaagaaaagtaataaaaaagaaaagcatccgacacaataattgcaacatgaatttgctcccttcatcctcagagccattgtccctgatcttccttctgcctggagtgtttttcaccattagccacatagatcccttcactggctcatagtctttgctcctggagaaacatgggaacatgtgaataaagtagaatgctcaaaaagtttattgcagcattgtatttcatagttaaagaaaaatcattgtattagtccattctcccactgttataaaaatgctgagacatgataatttataaagaaaagagatttaagtggctcacagttccacagaccatacaggaagcacagtagcatctgtttctggggaggcttcagggagcttttactcaagatggaaggtaaagagggagaggccgtcttacatggcaaaagcagaacctagagagaaagggaaggtgctacacacttttaaacaaccagatctcaggagaactcaggactgtagcaagtgggaaatccacccccatgacccaatcacctcctaccaggcctgacctccagcattgggtatggaatcctgattagggaaaaggagtcaggctagcaggaccaggggaaagcaaagggataaagaaaataagctataggtctgcctttttttcatggtccaggacatataaacagaaagaggaagcagataagctataggtctttctttatggctcaggacctatagctctcctgagcaaataacgtacataactcacagacttcctgcttatcatcaaacacctctatctatcatcaaaaacctcagttgacagaagaatgcaagttagttccttgctaccttggcattaccagtactgcatgcagcactcggcaacccaaaaacatcctataaaatctccagcaggcctttgtttccttgccatcagctcctcttcggctgattgctccctggcaactactttcatactttctttaatagatctgcctttctttatctacaacagtcttggtaaattattttatccccacaccaccagcccaggtagtcatcactcacctgggacattggggattacatttcaacatgagatttgggcagggacacagatccaaactatatcacacatcatcttaagtcttcatcaatagggagaggactatataaactgaagtatatctctaatagggtgcaatgtagcagaagttcccgtatgtgttaatataataagctctgcaagatatattattgaatttatagtgtgagttacaaaaaggtatacatgagatgcatcatttggtattaaattttaaaattataaatgaaatactatttattttcagcattttttgtatttagtacatgtatataatgctatagtaaaacatttggaagtatcaactccaaattgataagatgaagggagaattagggtaacgagtgatgaaagaatcagaactgggagtggtagtaaaagtggattttcgtctacctggtatgttgtattacttttaataatttcaaatgttcatgaattctttataatattaaaccaataaaaagtcataaaagccatcataaaggtttatccatattctattctattatcctcatgaaaaaggagagaaagagggaaatgaccaccctttttataaggtcttgtccaaccttcctaagtatttctcccacctctgggatcatatagcttttagttcacattctgcttaggatcccactctttgattctattatagacatgtgtagttttgtactcttcagtagattatgaactaatgtctcatcactttttacatactcttaaaacctaataaattaatcacttatggtaatacttcaaaaaatctttttggattttctaaaacaaaatcagagaattcaaataaatagcgcaagatgggaattgtcaaattattttaagatattaatttccatgaagtggcattttaaaagtggtaattggttcactgttaatccccattcagtctaggcagctatattgttttctgaccgcctccatttccttcataggaaacatgaagtgaatggggctgtgtgtgtgactactgaggagttaagttggtgcaaagtggtctttgttgatggtttcagtccactagggggcactctaggacttccgaaatgaagactttttctgatggtctcagcggacggaacaggatacaaaagggcatgtgagtcagtcaaatcacagataacagggagctggggcggggtggagcgtgatgtgtgtgtaaggttcatcttaggttttcagctctgacattctatataaaacctcagaaagctggagttcataggtctataaatccattgtgaggatgattctgtaagcagaggtaagggaattggagttttactgggcattgcgagcatggatgttcattagaaaacatcttcattccatgttttcagtttctaaatttttatgattaaaattcatgaaattcactgacttggaaattattctaaatacccctgatatctgatcttttcatatatcttctctgagactagaaggaaaaagaataaacagaagagaagaaaataggaataaaataaggatgaagaacagaaagagaatagggaggggacaatatttaatttgaccagcaatatgtggcctgatgagaacagctgtgagggcctgcagggtgtgtggggaaaggtctgggaagaggaaggggagaggtagaaatgcaattagagtggatatcatacgcacatcctatttttcctctaaccaaccaacctctagttggaaacattttctaatgccctgatttcaagaaactatttatttctaaatttgcaatgcatgctatcaaatagttttcctttattagaattttcatatatttgaattctccaattttctgtcaaactgtgtaatttgggaaatgggatctctcttcccatgactctttaaagctctatttaacctagctgagacacagattcttctgagaggtatcatcccccttcctcacatactatccataaactagtcttacataaagtgcttcttttttttaaaaaaaacctatatcttcatacattagaaatattgcctcttcctctcgtgaactattcacacccatgaatttggagagattgctgtgcagtctcactgggccactgtgggtggtttcctcttcagatgatttttaaaacttatgtttttaaacttaaaaacttttaaataaaagactgatcatgaacattgcaataaggcaagttgaagagtacctgaatccttcaaaaagtttagaaactctagtattgaaaattaatacattacaatttgaatatctgcaggtttcaaaatagaaattaaatctaagtgtagcagcttgatagaaaggaacattattttcatgcaaagttttgaatgacccagttatcgacatagaggctaattttcaaatcaatttttcttataattgaagatacaatggtaggatgcacaaacaaacatagtgaatcatatacatatcatgaagccactttgttacttttttaaacaaatttttttttaagagaagtggtcttgctctgttgcccaagctcaagtgcagtggcacaattatagtttgctttagccttgaactcctgggcccaagtgatcttcctgtctaggtctcccaaagtgctgagatcacagaagaccctgtctctgcttctgaaggagcccaaggattggttagggtaagctcagacccactagattgcctgtgggtgtgaaaatggtcttgggagttccttgatgcaggataacttctgcctactcccatgctctatgctgtacacaatcagtcctcagtaaatatttgccttgttaaatagtataaaagaattttagacctataaaagcatttagaaaccttttagttcaacttcattttataaacacagaaactatatccaagatgccagtatgaaaccattagatagtaaatgatctagcagtagaaagaaactggatttcctcccttcctccttagcttcttgctcttgcctattcctgcaggcacatattgttgaacaaagagaaactatctaatggcagccctgccaggttgacctctgcattttggttccgggaaaggcttggttcaatcactttgaccatgagaacggagagttccagtttgtgtaaacatttaccactttgggcaagaaagatattcaggctgagccactgttattctaccaggaaatccagtccatgactcactggctgctgtaggagtgagccaaacatggtggtgccaccctcaacccccagaggtatttctaaggactttcctaaaaatagtaagatatattcattatgctgggtggatattccttgaaggaaggatgtggacatagtgagcattactctacattgtcaaaaaataataattagaatagggaagctaagggtaacatgtcctcaagtggttgatagttcataaaggtgtgagaaaatcttttctggaccaacacattgacaatgagttaggtaatattcaatgaaataatcatagggttgggaattttgtccaggggatggccatacctaaggcatagttaatatgtggaatactatgatccatatgagtggtcatatttagaccattacattcagttcttaatgctatactcaaaaggccaaatattgacctaaattatctgtcaccaaaaggagggaaactcatccaataaaggatttgagaattatattgtatgaggaatgagtgagaaaagagaaaatccttagaatggagaagttttacatatgtaaaaacacacattttatgtatacatatctatatttatatgttttagttgctatttttcatcataactgtccttacatacttaagggtgcaagatgtgaataagaaattatattcagtctttataattccaggggcctagtgagtacaagtcacaggaaatgcacttttcttctggaaaccagatagtcttggtatctgaggaaccatttcccatggtcacttatttagttttgcactctccctcctagcagacacaggcaatattttggcttccatagatttagttttatggaagtaatcagaacgtatcaaaaattaaagtagataagcaattttttttgcaagaagagataaacccagaaatgtacaagactgaaggactttatcaatatcttagggaagaacactgtagtggagtttgggagaaaaacggcagatatggaacctgagctagcaatggctaaggcaagagcagtccatgccagaggagttggctcatattttagaggcaagttccactgaagatatgagtcaatcattgtatttaaggacatgccatattgatatcattcattttggtatcagaaaataaaagcaccttaatagaaatttacatgtggtttcatttttggagcctgcagcctgatgttttctgagaatttctccttgttttttctgcactttgcagaatacaagccacatagcaataggaaaaggtttcttaaaacatgccagatttctccttgcaaaccagcccaatctatgggtcaaactttcctattgttggagtatttaataactcatggaacttgttcccttcctcctttatcattgtactttaattctttaccttttattaaagccatccttaccaaagaaagattccacatttcgactgttggtactgtcaagtctctgggaatagaaagtcatggggaagaccagtcttggagaagcagagcctgagataatatgcacgtgaaatattgagtagtcctctctctcttactcttatctttggcttacatattcctttaagaaagagtctttctccataacaaacaaatcatgatgaccgatttgactgcaagggaatgtattacttttgtttgtccaggacagtgaatcatggtgttttcctgatttcaaacatgtaaacttggtgcatcattgtataaacacctgcaacatctacctctttctaactttttaacaatgactcattagtttgcataaatatcaatcttgatatctacattcttactgtgaacttcatctcagagtgaagactttatttgtttgacctattgctccttttgtgcatctgagtccctcctagggttatagaaaaacattcaaactgcaagtttagtagctacgaatgtgaccacaagatggcagtgcttctctgctgatgcagaacacacagaggtttcattttagtggattctgattaaataggtttatggcagaagtagagcctttttctattggctgagtagacaatgtgagaaaccactatgattgttagaggaaagaaaggaatacccgatgatggaagtagctcttatggctggagattgcaggtttatgactgatcctatttgggaagaacaatgatggcaggcattcgagctttatttatgtacttgtggctgcagctggactgtaagtttagagttttgggtaacacagtatattagttgatgattttgagacatccagggggaagtcttgctttatttaggcttcctctagttactatagaaaaagaaaattctggagaataataacttgataaacctttctctttttctttctgcacaggggtgagcagaggagagagtgtggggctgcatcttcctaccctgagtgtccaggagggtgacaactctattatcaactgtgcttattcaaacagcgcctcagactacttcatttggtacaagcaagaatctggaaaaggtcctcaattcattatagacattcgttcaaatatggacaaaaggcaaggccaaagagtcaccgttttattgaataagacagtgaaacatctctctctgcaaattgcagctactcaacctggagactcagctgtctacttttgtgcagagaatacacattgctttccaggcatctgtaaccatcacccaaacctgagatgggaggtgaagcagcatccctttcctttgcaataaattttagttatagcacttgtcattttgtttgttcataagtggaaactaacatatagatattaaaaccatgtaatgaggttagattcaaagtgacccagaaaggtttagagcattttgttggccagttgatgcttaatggattccgtttttcaaaaaaatatatggtacgcatttaagttaacaacatgaagttttgacacacatgtacatagtaaagtaaagagtcagctaaagagacgcatagggcaaggtatgggaaaaatggccctgagcttccatgccttctctggctctgccacccaccacatgttcagcaatcaggaggttctgctcaagggatccttacagagatttagtgatgttggattttgtaatctagtcttcaaaggtgactttacatttgctattcagacttctctcctatgaataaccccttagtgtcaatattgcaatccctattatggataaattttaacttttagttttcaaaaattgcttttgttatctttttcttattgtaaaacattacatgccaaaaccagatagtgtaaaatataaaaaatacaaaattgataattctgtacccagataggttttgctaatattaggttggtgcaaaagtaagtgctgtttttgccattaaaagtcatggcaaaaataacaattacttttgcaccaacctaatatttagatttgtttcttgatagagtcctattataattaggatcatgattttttcacctattcttatatctcgaattgagcttttctcacttcgtcctctcctcaaacacatgctttttaatagctccgtgagaaattttcaccagtcacagttatttttattttcttactctctgtatctgtggtaaaatttggcagtcccttctacctgctgtttcttgttgggaaaacgtgatgagttttcctttagagtctagtttggacatatactctgtgtgtgcgagggaaattaaaacaggaagtgattttaaaatgtgagcttcagattagagtcatcagtatattcttcaaaatcttattggtatctcttcatatttactctctcacataattgagaagagttatgttttttaatcactctgtttctgcagaacctagcataagctttttcacattgttaataatcaatagatgtttgttaaagaaagaaaaaatggattaaactattgtatattcaaaattttaacttaggctttgtggttgaattaaacgtataattttatgtgtgaataattaaactcctgaaaatgtatatttgaataagttgaatatttgagagcatatttctttccatttatctatgtcattcttttccataaaactttatcgttttaagataattaaatttttttctagacatttcatttttattgctacctttatctttctttctgaggtatgtggcaatgtttttaataaatatttttcagctacattattcaattcttattagtaaattgcaggaggcatttggatagttaatttatgctaggttgttccaaataccccgcctcactttcgtgttttgactgctttaaacattacgagtgcagtttccttttcaaaagttgtatcttttcgtgttgttgataaaaataatggaaataaagaagttgcataaataattaattccctaattctcccacctgtggtcaagagtaggctaatttcaagatccctcatattattcctaaggatggatataaccggcgattggtagggtgagaatgatcccttctggctgagttatggctgttagttattagctaggtcttataggaaaagtcattagattaaattggggtttaaaaacaactgaacaaggaaggtcagtattgtagcccagtaactcaactggcttttgttatttccctgtctataccactagctcctctccggagaagcaagctgactcttgatcagtccatttcctccaagaatgaaatggagtgattgggaatcatggcttatagtctatttattttttgcttgtttagaagaaagagtgtaattgctattggcttaattgctgtatcttacttggttgtcaatttttccaatgtaagaaaaaaaattatccagctagagtgtgcaaagtcagtacccagcttagatccagacacattcaagcattaaactttaaatggaaaagagtactgatgaggagagacattagcaggtaataaaatttactataaaattaccttctgaggttggcatacaatgaaacagatcaaaggagctaaataaaacacattgaacaaataaaccaaggtttatgtatttttttgttgcctctgtacaaacttgctgtcttaaaacaatagatacatatttttttaaatcatcttcactgggctgaaatcaaggagtcagtaaggcccgcttcagaggctgcagagaagaatctgttccttgcctcttctagctttgccagcatttcttggcttgtggtgccatcaccccaatccctgttgctatggtcacattggcttttcttcttatgttgtcaagaacacatttccacaagttcaaaggcaatatttctttgaaaatttttttgaataccaagtcacccaggtttaggtaaagtaaaagctgattaaatgaaaggccaggaaggaaaacctgtacctgttggttaaaggactgaatataatgagtttatttatctattaatagttaagtgtgtcagaatggaatatgtgtggttcagaacattctgagtaatatgggcctactagtgaccagttcatagtgagatgacacatgactttgggatggggaagaatgcagggccactagagctaagggtaataatgctttaggccacgggagttcacagatgtctgatagggtaactaattttattcttaatagtcatacattgtttcaacattttcagaggaccaggaggtgataagaaaagcagtttctgagtgagagcaaaaccttacataactgtcctagaaaaacatgttcctctacatatagataatttgattggcacagataaaaaatggaaatcaattgatttagctattgtgagtgctgtatctttatgacgggtgagtgcttcaacccatgtagaaaataaaacaactcttactagtgcatactcacaaccccttagggagtagaactgtctgaaacatactcaactgttcccttaggacagtattccagttcatattccacttttacagttttcatggaattttggagcttccaaaaaagacatgaactgtctgcattccctagtattctagaaaagtctccccacaaatgtttaatattgcagtcaacatgtccctactgcgatgggtggtccctggagggtattaacaagtgttcattggcaatcatctggttccaccaaacagcctttctggctttgatatatcttatcctcactgatcaaacaaatcaataattcatctaaggtggagttattgacattttccatggttgcatctttaagttccataagaggtgcttgcataaggactttagtcagaaagccatgtttagcatgatcccctgctcacgtatttttttctagcttctaaagtgcctttcatacatggaactttgtcttcattaggaaatttatttcaatagcgtcaagacatcaaataatttatgtatttggtgtccatttttataaagatacatgaaatatatgagaaggttaagaagaggtaaaggaggttaaggaacctcatcggctccattatatttggaagttgtgacctgtgttaaagcattgactatcactgtttatatttatcataatttggcatgcaaaaatgagagtcacaatttcagccacttgcattaattttacttctaagagattgaattttataatagagtcgggtagttattacataaaaagttttgcgttattccttttcaactttgagtttaatacattaaaacaattaattcagaagttgatacgagactgttcaaaatatctgtttgagtgtggacacttcttaaatgacaaaagcacagttaaaagatttattgattgagaagtgtaatggagttgaacactatgaagataaatttgtaatatttcataattactccaccaactggtagaacaaataatggatgcttttacaaaatagataacttgtactgtacgtgatatcataagatatctgaagacgcttcaaccaattttgacaagaaagatctgaagacgcttcaaccaattttgacaaggctaagataagctattttaagacaagagcgataagctatggctactatattaataaataaattatggtaggcaaggcaatgacctgagttgtttgcagtgttgttgagtagtatcactagggcatggtctttaatgtttacacagaaagaaaatttgtcacaatcggtgatcctgtaatcagttgtcctgtatatgggatcgtccagaacacattctcttcagagcggggcatacagaacggcgtggcttgctggggcttatttggagtctgaattgaagtcatggaaaaaatataaattcgaaggtttgataacctaataaccaaactctgtaatctaatatgatctgtatgaacagagctggctgttgaaactgaatagaaaagagaatgggacctttaaaacacaacttgatatctgaggggttaattctaaactcttcgtcaaagagagattcgtttttctgctgtttggccccaagattggcaactggataggcattggaattgaggaggaatactgttatatcaatagataagtcaaaagatctgcagagatttgtacaaaccttcttatcataacatgatgtatttgtactttaggagaaacaacaacatacatagatgtgaggctagaggattattgtatcttacattgtctgtataattcattacaggtatcaaatatgtgtcaatctcccagttccatcacaggtgcaatgataaaatacagtagttggtcaaatgatcatttttcctctcaatgtgaccatgtttattttcagatttgttaacaaattaagagttggttgatccaaaagaaagtctgcattgggtgagcttctcagccagtacatagagaagtgtgagatgacacacactagtttgctataccaggaaacctctgtttcctgttctagggcagcagtagcagcagcacatggcccagtaattcttctctcaccatgccaggttcacttcacagtacagagtcctgaaaataaagaagaaaatttttttttatctagaaaaagaaccaaacatgtcactttctagcctgctgaaggtggtcacagcttcactgtggctaggtatgggtggcccagtgggaatggactttctgtatgaactaaggactttggaagtatctttatggaaactttgggaaggaggggtaatggggtacaaaaattgaatttctttgtcccaatccactttatccttaaaccttcaaattctatcttttttccttcaggacctggcattgcccagaagataactcaaacccaaccaggaatgttcgtgcaggaaaaggaggctgtgactctggactgcacatatgacaccagtgatccaagttatggtctattctggtacaagcagcccagcagtggggaaatgatttttcttatttatcaggggtcttatgaccagcaaaatgcaacagaaggtcgctactcattgaatttccagaaggcaagaaaatccgccaaccttgtcatctccgcttcacaactgggggactcagcaatgtacttctgtgcaatgagagagggcacagtgacagaactgtcggagggaggtgtacaaaagccctggggacctgcttgagacctccacctgctggagaaccaaggcgggaaatcaacatcacagacaggaagtggctacagctgtggcagcccagatgcagtgttgtaggaaatacacttaactctaagaaaatacctctttaagttcatagaccatgatcaaagttatcattaactaaaaactttcttatccctgaatctttggtttaaagtttagacataccaaatttgtgactgaagattgaagagaaaaaactgccacaataaacaatttgccatttggctactaaattgaactggattcaaaaacatgtgactgaaaaatcatttaaaatatctgtgaattttcatatcaatttgttcagtaaatactggagatctaaaaaaagttcatgaaaaatacgtattataaaaactatttttggatttcaatttttttttgcaccaaaataaacttacacttaaattgctataacatatgtagacaggatctactttgaggcactaagaaaaataggacagcaatttgaaaagaacccctattagagcaacagattctgctaaaatgaagcaaaggaaagcttcacatttatggtgaaggttgggtagtagaatggtgaaatcatcaattctctatgaaactttacgaagtcagtgctccaaataaatcagcagttagcaagtggataactcattttaagaagggatgagacaatgttgaaggtaaatcctgcagtggtagaccatccacaccaatttgtttggaaaaagttaaccttatttgtgccctaattgaaatggactgatgattaacagcagaaacaatagccaacaccacagacacctcaatcggcccagcttacacaattttgactgaaaattaaagttgagcaaactttccattccatgggtgccaaaactattggacctagatcagttgcagacaagatcagagctttcaataaaaattttaagcaagtgggatcaagcccctgaagcatttctttgaagagctgtaacaagagataaagcatggctttaccagtataattctgaaggcaatgcacaatcaaaacaatggctaccaagaggtggaagtggtccagtcaaagcaaaagtggaccagtaaagtgcaaaaattatggcaatagttttttgggatgctcaaggaattttgcttgttagctttctggagggccaaagagcaaaaacatttgcttattatgagcatgttttgagatatgtagccaaaactttaggagataaatgcctaggaaagctccaccagagatttcttcttcaccatgacaatgatcctgctcactcctctcatcaaacaagggcaattttgtaagagtattgatggaaaatcgttaggcatctacatagccttgatttggctccttggacctctttttgtttcttaatgttaaaaaaatctttaaaaggcacccattttcttcagttagtaatgtaaaaatgaactcattgacataattaaattcccaggaccctcaattatgcagcaatggaccaaatggctagtatcactgcttacaaaagtgttttgagctcaatggagcttatttcaggaataaggtttatattttttattttgattttactttacacgaaccttttgaaatgtccttgtatttattgtgttatagacattattttaaataggaaaggcattgaaatcttttatatttcccttctaaatatattatgttgtttatattgtttaatggattaatttgatttaggtttgtttgctgtgagtaaatggtacttaaacatttattttctaaaggtgtctactatgtgctaagagctcctttcatcttattaacaccttgaatgtggaagaaatcagtctccatactacagatttacctgcctctcaacattcctatccacgaagtgatcattatttagtggcttccagaaggacatgtggagaatgttcctcacagaggcacaaaccttttcatttatatattaataagacatcttttcttctaaaatgaatcaccatttttgaaatatatgaaatttccctttccctataatgtttccacatggtttatttcgttccactgatctatttgtttcactctatgacaatctcagaatgtagttttatagtaaattttataatctcttagggtaaatcacttttcaccaaaaatctttttcaagattttaaaaaataattcttgcacatttacttttcagtatgttaaaagttctgtcacattttcctcatgttcaatacccttctattaaactgacaaaacaaaaatgtctaaaaaccagacagttgaaattgcatttaatgaatatgttaacaaatatcaacttgttttcgtatgtttttattcagtaaaatgatattttttctaattgtaaaggatcttttatgttctctattacattgtgaagtttcttacttttatcttcatatggatttgtatataactgttcccacacatccatctatatatatgcattttaaatgaaattatcttttatatattcatttttactgatattcccagtacaaacaaatgctatttaaaaatcatcttggttatatagctaagagtttctaactttaaagtacagataatttgcaatatattcatactacttgaaccattaaagtttattttatgaacctagactaacctcaacccaacacctaaaaaatagcatgataaaaatatttactctccaatttttttttttaagacagagtctcgctctgttgctcagactggagtgcagtgccactatctcggcttactgcatcctttgcctcctgggttcaagcgattctcctgcctcagcttcctgagtagctgggattacaggcgtgcaccaccaccacacccggctagtttttgtatttttagtagagatggggtttcaccctgttggtcaggctggtctcaaacttctgaccttgtgatctacccgcctcagcctcccaaagttctgggattacaggcttgagccaccaagcccagcctactctcctattaaaaagtcaagaaacaacagatgctggcgaggctgcggagaaataggaatgcttttacactcttggtgggaacgcaaattagttcaaccattgtggaagacaatgtggagattcctcaaagacctacagccagaaataccatttgacccagcaatctcattactgggtatatacccaaaggaatataaatcattctattataaagatacctgtacctgcatgttcattggagcactattcacaatagcaaagatgtacaatcaacccaaaagcccatcgatgatagactggatgaagaaaatgtggttcatatacaccatggatactatgcagcaataaaaataaatgagatcatgtcctttgcagggacatggatgggggtagaagccattatcctcagccaactaacacaggaacagaaaatcaagcacctcatgttctcacttataagtgggagctgaacagtgagaacacacggacacaggaaggggaacaacacacactggggcctgttggggagggaggcggagggaaagcatcaagataaatagctaatgcgtgtgaggcttaatacctagataatgggttgataggtgcagcaaaccaccatggtacacgtttacctatgtagcaaatctgcatattctgaatatgtatccaagaacttaaaagaacatatttaaaattcattgaagaaattgaacatatatttgcaagtgtcccatgccaatataaaacacattataataagcatgtatacatcttattaaatcagaatgaatatccatatattcatattcatataacttgataaaaaatagcagttggatacatagtattaatttaaaaattctagttttaaaatttataattttagatttttaatttaaattttaaatttcaaatttttaaaatacctcattttatttctgatgtctggaatcttatttagttgaaaatgtctctttgaattctctgagtaccatgagcttgtatagcttatgctgctgcctctaatgtagctgctattgttttcaatatggaatgaacaaggtgattggatttcttgaaccacttactataatagaacctctagatatttctaccaaataaagagtagagaacaaattaaaatacgccaaatgtatttttacagctactttcacatctattagatggagtctttcatagacattttatgaaagagtttcataatcctcacacttgttacaacgtacagtctaaacaggcaagatctattcactctaacataatatctaagggatggtgtgaaggatattgcaagcatatacacacacacgcacacacactcacatctcaccacaagttagagtttacagatagcggtttacctttgaggtagttagagagaaccagtaaagaagtcacacatattcagcctaataagtaattagttcaaatctaatagaaatgacatctaaaattggaatcttagaaacaagactctactaaaagataactttggaatgcaccaaaaatcagttttttaattgagaaatattgcctttcactaactcttcagtcattatcattgtatttcttggcatctacatctgggaaaacctttgtaaccacaggtaaaatgtaatatggaaatggtcactctaccttagtttaataaatgtattcaattgttttagtgacagaaaatttactcttgaatagagatgcaaatatttaaattaagtaattaaaacccagaaggcagtgtattaacaaaataatgcagcttgatttttaaaaagttattattattattattttttttattattatactttaagttttagggtacatgtgcacattgtgcaggttagttacatatgtatacatgtgccatgctggtgcgctgcacccactaacttgtcatctagcattaggtatatctcccagtgctatccctccccccttcccccaccccaccacagtccctagagtgtgatattccccttcctgtaaagttatttattcacttatatatccatttatttttaaaaaatcattcagcacctacagagtgacaaactttgtgctgagaactcagtccatttaacaatcttattgcaatctctagcatgtaatagctcaatttctatactgtaggtttacctgccccataccagatttatccataaaatgattaataaattagtggctcttagagggacattgtagagaggcagaatttgaagtctttcttttctctgcttttgtgcttcattttacccctctttcaaaaacatttaatgccatcatgtggatcaactttgcacacccccagacctgttccaccatccaaaatcctcattcttttcaatcttctccttctacctccaacaccattttctccttccctaagctttgaatggtaatggttggttggtaagtgatcttgtattgtaacatcctcttgtatttgcatttgaaaagtagatgtgtatagtataaatcttaaagagaaatatgtttaaaaatttttaaaattatttttaattgtggaaaaatatatataacataaattttgccatgttaaccatttacaaatggacacttcagtagtgttaagtacattcctttgttgtgcaaccatcactaccatccatcttgagaactcttttcattttggaaacctgaaactctgtgactactaaacaatagctctctattttcttctccacctaatccctagaaaccagccttcctttctgtctttataagtttgactactctaggtactttgtataactagagtcatacaatttttttttgtgactgccttatttcacttagcgtaatgtcctcaaagttcattcatgtcatagtatgaagcaggctttcagaatttccttcctttataaggctgcatattattcaattgtgtgtacataccctattttgttaaactatttatctatcaatggaaatttgagctgtttctatcttttggctattgtgaataagctgctctcaacaagagtatgcaaacgtctcaatatttggggtatatcccccaattctttcaactttagaagtgatatacccagaagtgcaattgctgaatcacataataattctatttttaattttttaaagaactgccaaactggtttccacagtggctgctgtaccattttacattttcaccaacaggacacaggtgttttgatttctccacatttcatcagcacttcttttactatcattatttttgatatgaatagtagccatcctaatgggcatgaagtagtatgtcattatgatttttatttgcatttccctaataattcgtgatgatgagtatcttttcctgtgcttattggccaattgtatatcttccttggaaaaatgcctattcaactactttgcccattttgaaatggggtgtctgtctttctctctctctctttctctctttctttctttcaagatggtgtttcaccatgttgcccaggctggttttgaactcccgagctaaagcaattcacctacctcggcctccaaagtcctgggattacagatgtgagccaccgcgcctggcctgggttgtcttttttttctgctgagttgtaagagttctttatatattctggatattgatcttttgtcggatatatgatttgatatttttttttccattccatgggttgtttatccactctgtcactccattaattgtgccctttgatgcacagtagtttttaattttgatgtagtcaagtttatctaagttttcttttgcatcctatgcttttggtattatagccaagaaattattgccaattccatgctttctgaaggctgaaaaaaaagaaaaaaagaaaaagaaattattgccaaatctaaatcgcgatgcttttcctgtaagataagagtgcagtttcactcttttgcatgtggatatccagtttttcccaacactgtttgttgaaaagactttcctttcacccttaaacagtcttaggaccctttcctaaaataatttggttgtaaatgtgaaggtttaattttgggctctctattgtattgcattggtctatatgactgtcattatgcaagcaccacacagcttttgctatattactgtagctttgtaatcagctttgaaatcaggaagtgttagaccttccaaacttgttccttttcaagattattttggctatttggggtttcacaagctgccatatgaacttttggatggatttttctattactgcaaaaacactattgggattttgatagggattgaattgaatctgtagattgcttttggtagcatcgacattttaatgatgttaaattctccaatccataaatatcagatgtctttcaacttatttgtgccttatttaatttatttcagcaacatttttgttttcattgtgcaagtctttagcattgttgtttaagtttattcctaagtattttattctttttgatgctattgcaaatggaattattttcttaatttccaaagtgttcattgttagtttatagaaatgcaattgatttttgtgtgctgtttctgtatccttcaagtttgttgaattcatttattagttctaactacaagcatatttaatggtggaatttcaggtgttgtgacagcagattggagaacaggacatttgtctcatgtccctcaggataactcatgtaggctgcaaaacttcaagcatacatagaagcatcaacttcataatgtaatcattttatatctttaatacatcaggcccttcaaaatttagtttaaatgttgagaagtcaaagaatgatgtccttctaagaataaatattctaacacatgatgatgtgctgaacaagatgaagaatttgtatttggatacatatttttaaagcaatgtttagttagtaattgaaaatactaaaccaggagaaaataatgtgcactctggtttccatactagagagatatagaagcagaaagttttacctcagtccacagatctagtaaataaacatccaacacttaaacttgggtcatttgactccaattgatgaattttcagcaaacaatgaaatataaaagtaagccaattcaatatacaactccagaagttataaaattaacagtaaaataaaatggttgagagtagattgaaggaattaaaaataaaagcaagaaattaatggctcaaaggaaaataacaaaatcaatgataaaaccacaacatgatattttgaaaataattacaatactaacatgatccagaaaaaaaaagtgagaagggacaaatgcatgcacaaaaaaaaacaacataattaagttgaatttattttgggaatgtaaagatgatttaatacttgaaaatctattaatataatgcttgaaattaacaaactttaagaaggccaaagatgttctaatgcctggtttggtggattgtttcatttggatctaggatgattcactgtacctgtgcatttgtgcaagctcatttaatttggttggctcttaaaaatattcggattctttctcttaatttgaccccaattatagatatagtgttattgttcttaaatttcttgttgcatttagattatttctatgaagaaaggggaaaatgataaatttattcaatcatatttatgacaaagttttggcttccatattattgtttttgtatttttcttttattgtgaagtgtaccaagttttattttagaaattgctggaccagtaaatattgttcaagttgatgggttgtatagacttcagatttttggaatgttcttgaaaattattcccatttatgtccttaaaccttgcataatcttgtgaaataatgcttcataacaatgactgactgtgcacagattaaacaatgctttaaataatgttagtcattaggaagaattaagctatgatcctgtatgtgagaaattttcatactggttaatttgaacaactatgctttagactcctttatcacaagcaagtttccaggaacagaaagagagtggtcactggccatgaataaagttccagtactctggtggttcacagaagtttaggaactttttcagccttgctaccatgcattgctcatcaggtgtttaataattggtctgaaaggaatgcttatgccactacctggtggtcagctcctaaactgcagtttattcatcctttaaaatatgttttctttcctcttttagtcaaagaatgagacctgaaattatttaattattttaaaaaatttcatttggataaatagagcacctattaacttgctgtcttaaaatatttcaagggcttgggaaaaagtcacgttggtgtcttctaacttctctctgaaatttctctgaaagcaatttatactggaaaaaatagggaacacatgttttgctattaatgagatttatgttcaaaactattaactttgccatgtacttacttgctgaatacttttgtgttttgttacattttttttgtaaagtgtgatagtgatagcttctttagtatttgttgtgagaattcatcaataatgtatcaaagaagattaacaagtagcagatgatctaacaatgagaatattctcaatagacccagaaaaggcatgtgacaaaatccagcatccattcctgattaaaaactctctctaaatgagaaattaaaaggaactttctcaacttaatataggaaacttacaacaacctatgtcaagtgtcatacttggtgaaaaactaaaggcttctccctaagatcacacataagaaaaaagttattgctctcactgtttctgtttaatattgtactagaatgtctatccagtgcaataaggcaagagacagaaacaaaaggcatacagtttggaaaggaagaaataaatcaagctttatttgcagacaacataattgtttaagtagaaaatccaaagaatctgcagaaaatataccagaacaaataagtaagattgtaaaggttgcaggataaatgatcagtttgcaaagattaattgtatttatatattttcacatgcgacaatcagaaattaaaaataaaaacacaataccatttacaatagcatcaaaaatattaaatgcttacagataaatcttacaaagtatagaagacttggtaacttaaagccacaaaacctcatgagagaaattaagacctaaggaatggagagataaactatgttcatagattgatagactcaatattgttaaaaagtcagttctgtttcaattattctacagattcaatataaccacaataaaagttctgtcatttttttggttaaaattagcaggctcattataaaatttactcagaaatataaggcacctagagtagccaaaacagggttggaaaagaaaaaatttggagggataatattatcttacttcaagttgttttccacagtaatcaaaacagtgtggcatttgtatacagatagactaacagattaatagaacagaatagagcccaggaatagacccatatatacatgaacaactactttttgacaaaggtgcaaaggcaattcaatgtggaaaggatagtcttttcaacaaatagtgcttaaataattgaatatccatatacaaaaaaatgaactttgacactctcataccatatacaaaaagttacttaaagtgatcataaacataaatgtaaaaccccaaatcataacacttcaagaagaaaataggaggaaatttttgtgaccttggcctatgcaaacatttcttagatatgatagcaaaacatgacccataaaagacaaaaagttgataaattgaaaaattggttttcattacaacttaaaactgcctctggaaacaattctgtcaacagaattaatagatgagctatagactggaaaaatacttgcaaattgggtatctgagaaagtcatttatttgagttatgcaaagaacccacagaacccattaacaaaaaaaaatagaaaagtaaataaaatgggcaaaagatttgaacaaacacttcagcaaagaaactatatgaatggcaaataggcatatgaaaacatgcttagcatcattagtcattagggatatgcaaattaaaatcacaattaggtactactgcatacctattagagtggggttgacaaggatgtggagcaactgcaactctcaggtactactggtggaaatacaaagtaatataataactttggaaaataattgggcaggttttaaataagtcaaatatacacctgatatcagatgcagccattctactccaagttatttgctctaagagaaatgacagaatacacctatacaaaatcttgaatacacgtttgtagtaactttatttgtaacagcctcaaactgggactaactgaaatgtacatcaacagataaataacaaacacattgttttatatctatataatgtaatagtactactcagcaataaaaagaaataaaccattgtttcaaatgacaccatgaaagaatctcaaaataattatgctaagtgaaagaagataaaccaaaaaaattgtatatgatttaatttgtataaattataaaatacacaaactaatatatagtgacagagaattgcttggaaatgggcatgggagataggaaggttaagagaaaaagtacaaagaaatatgagaaacttttggggtgatgtaaatattcatcatgttgattgccataatagcatcacaagcctatatgtatgtcaaatcttataaaaatgttcactttactttggtgcagttaatttttatgtcaattatacatcaataaaaccatttaaaaatccaatttaaaagtacatgtcttcaacatcacagaagtattctgatatggtccaagatgcaaactgttctcactgggtttaaactatttttcttaagtatggatgacaacagtctacacccatgtgctctactgtttattttcaacccagcatcattccagcttattttgcattcccctttgtatatcagaatagaaatttgtagctgattttccagaattcattttcaacatagttctaggcttgtttctgacaaagtgatttggaaggtggaggagaaggagaagagatttgcaaacccaaacaatatctgggcctgaatttcttaatgaagtctgtatctgagaaactattcatatgctgactctggacgcattctttatctgaatctggggagagtgaactccaggaaacagactgaactaagtgtctgttcttagctatgtgtctaggtataaatgtttacaggtccttgcagaaagttagatccttctcccaaattttactctgataacacttctggaggttttttcttttctttttcattttatttttagatttacatgcggaggtttgtaacaagagtatgctgcgtgatgctgaggtttgggctcctagttggtcacccagatagtgaacatagtacgcaacaggcagtcacctggatagtgaacatggtacccaataggatgtttttcagcccctcccccctccatctctccctccttttggagtccacgatgtctattattcccatctttatgtctgtgtgtgcccacagtctggcttccacttacaatgagaacatatgatattttgttttctgtttctgcactaattctgcacttaagataatggcctctagctgcatacatgtttctgcaaaggatataatttcattcgttttatggctgcatagaattccatggtgtatatgtaccaaattttccatagtctatcacaattgatgggcacctaggttgtttccatgtctttgctattgtaaatagtgctgtgataaatatatgagtgcatgtgtcttttggtagaatgatttatattcctttggatatatagccaggtatgggattgctggcttgaatcataaatgtttttttagttttctgagaaatctccacactgctttccacagggctgaactaatttgcattctcagcaacagtgtataagcattccattttccctgcaaactctccagcatctgttattttttgaattttaataatagctattctgaccggtatgagatggtatctcattgtgattttgatttgcatttctttgatgattagtgatatgaaagattttttcatatgcttgttggccacttgtatgtcttctgctgacgggtgtctgttcaagttctttgtccgttgtttaatggaattatttgtttatttcctgttgatttcttaaagttcactacagattctggatattagtcctatgtaggacgtatagtttgcaaataatttctcccattttgtaagttgtcttttaactatgttgatagtttcttttgctgtgcagaagccttttagattaaataagtcccacttgccaatttttgtttttgttgcaattgcttttgagaacttagccaaaaattctttgcctaggctgatatccagaagtgcgtttcctaggttttcttttaggatttctatgaggtgttacatttaagccttcaatccctcttgaattaatttttgtatatggtgacagataggggtccagttttattcatctgcatatgtctaggcagttatcccagcaccatttgttgaatgagtcctttccccattgcttatttttgttggctttgtcaaagatcagatgatcataagtgtatggctttatttctcggttctctattctgttccatgggtctttgtgtccgtttctggaccattactaaggccaagttttagttacttagccttgtactacaatttgaatttgggtaatgtgatgtctctagttttgttctttctttttgttaaggattgctttggctattcaggctcttttttggttccatatgaattctagaatggtttctactaattctgtgaaaaatgactttgacaatttgataggaatagttttgaatttgtagattgctttgggcagtatggacattttgacgacattgattcttccaatccataagcatggaatgtttttccatttgttcgtgtggtctatgatttctttcagctgtgttttacagttcttctttcacctctttggttagctgtattcctaggtatttgggggcatgtggctattgtaaattggattgcattcttgaactgactctcagtatgatcactattggtttatagaaatgctcctgattttttaatgttgattttgtaccttgaaacttcgctgaagtcattcattagttctggagtcttttggtggagtctttagtgttttctaggtatagaatcatattgtcagtgaagagagataatgtaacttcttctttccctatttggaggccttttacttctttcttttgcctgcttgctctgggtaagacttctagtactatgctgaatgggagtacagagagtaggcattcttgtcttgttcccgttctcaaggtgaacgcttccagcttttgcccattaagtatgatattggctatgggtttgtcatagaccactcttattattttgaggtatattccttcaatacttagtttgttgagggtttttatcgtgaagagttattggattttatggagtgctttttctgtatctattgagatgatcacatgggttttggttttaattctgcttatgtggtgaatcgcatttactgatttgtgtgtgttgaaacaactttggatcccaggaatgaagcctacttgatcccaggaatgaagattagctttttgctgtgctgctggattcaggatgctagtttttgttgagaatttttgtgtctatgtgcatcagggatttgatctttagttttcttttatcattgtgtctttaacagatttttggtatcaggataatactggatttgtagaacaatttagggaagaatctcttcttgattttttggaatagtttcagcatgattggtatcagttctttgtatgtctggtagaagtcggctgtgaatccgtctggtatgtggcttttttattggtacattttttattactgataagctgcacttcactaaaatttaaaagttacgctcttatgaaatgcaatgtcaagaaaatgggagacaaaatgcaaactgagtaatccattgcacttgaacaaatctttcttgatattttagtttctctccatgtaagagacatatttcagctgcatttagtctgccatcttaccaaaaacaggtttttgttttcttttgttatgttataaaatgaaaactcacaggaagtaagcataatgaagtgtttgtttttactgcagacacttcataggaaaagaccagctttaataatctgtgtaatcatggggacatttttttgtgatgacctcagagtgttatctctgatagttgataaccgtcttggtataggacagtgttcacaaataaaatcttgtaaacaactatcaggctggcagcaacaaaaccatcagggaagtttttaaaaaatgaaaccctttgaatcttggaaattgtggtttgaaatgttggaaatcgtgattcctaaagttagtagtcttgtcccaacatctgtaattttaaatgactcacaagttaattcagttctcacacaaccaggttttagaacctcgattatcagccgatgtatctttatcaatttgtaaagcaagagaagaggaaagttctaactcatgcttcagtctgttgatgcaaatctacatgtggattccctacatcatcagaggaaattgattaaactttggcaataaaatgttggcatatgaccacagtagaaagcgtccttgaggccagatctccagattatagggttaacacttgttgcctgattgtcataagcaagcaacttgtcttggagtcattgaaatcgtgagggaataagctattaatctgaggtcatatcttatcagtaaatgtcagtcactgctctacatgttaggatacagtgctgaaaaacatagactcagtaacagcaagacttcttaacattccctctgatttcaactcaaaacccttgtctgacatcccattgaattataccactggcctgcaatggatacgtaaaaatattggcctgtattaaaatatccaagaaaatggaactctcacctacagaaatactctaggatgctttgctaaagatcttttgtttcaggtagtgtccaaagaacaaaattgacaaaatagaccatagagatgacaacatctgcccttcatatttacaaggaccacctgagactggcatgggccttataaatgaggtcagggttgaggacctatttctgacttttggaaggagtccaggaaaacattcatcccagttcagcccctgtccaccagagggagtggcttcctaacacaaactcatttcctgctatcactgtaggtttcactgtgatttcttcatgttaaggatcaagaccattatttgggtaacacactaaagatgaactattctccaggcttagtatctctgatactcttactgcttggttagtgagatgccttttaaaatttggtctctgtcttctatcaagccaaaaaaatctttaaccataatttgacctaagagcattatgctcaaggctaaacagatctctctctctctctttttttttttttccctaggaagaacccgtggagattcagtgacccagatggaagggccagtgactctctcagaagaggccttcctgactataaactgcacgtacacagccacaggatacccttcccttttctggtatgtccaatatcctggagaaggtctacagctcctcctgaaagccacgaaggctgatgacaagggaagcaacaaaggttttgaagccacataccgtaaagaaaccacttctttccacttggagaaaggctcagttcaagtgtcagactcagcggtgtacttctgtgctctgagtgacacagtgacagggactgcagggggagctgagcacaaactctgagcagcacggggggcccggctgctgagtgtcagccactgtgatccactctggttctagcacagtctgtggttgtttgtgcctcagtttctctgattgatgcagtaatcatacacatggccagaggagaaaaacaagaaatgaacatccccaaacccagctcttggttagtgaaattaaaaacagacattgacaccaaatagttcctcatccagtgccaaagtaatttcaaggttaaaccacagaaacaatgaagctgtctctgtgatcatccttgcagacaaagttcaacccccacctcttgttccaggtcactctggtagatattggaggtggatgtgttctattacatttttacagagccaaatatgccagagaaggtggcgtctgtacaatgtctctgtaacagagtacagcaggagagatgacgtgagagccacagctcctcaattcagttcaaatgtctatgcaggattcttaatagagaaagaagggaagagaagaaaggaggagggacagaatgtcacatgtaaaaaaataatacggagaagaaagcaacaattgtcagagagagggaagttttcttttttggtaagccagatggtagacaaaggctgatgttccaaaaagaaagggaaggatcaaaatcattattgaagaaatgactcatttgtaaatcataagtattccttgcttgttacattgatcaattggctttctaacaacaagtccttaagtgagttagttttgcagtgccaatggaagattaagcatacagatttatatttgtatccctgtgaaatcctattaaagacacagtaaagaaattgaaaagggcataaaaccacaaaaagaatagaaaaggaggtgacagcagatggtgataccaatacaattttagaaggcaggagtgtatggagaaatgaaaacttgcatagcagaccagataaagaagaaacctgggcccagtgaaagaagacaacaaggaacaccaatgtgtgttgagcctttgtggaaaggtttagaaatcagaagtaccaatgacctttgaataattggtgaagataatgctttgtgtgtgtgtttctattttgagggtatttgaaaagagggtatgaaaagaggaggagaaagtgagaaaatgtataattaattgaccacccatgctctccaccactgcatgtataacaagcaatgctcacttcccaaacccagaagaaagctggaatttaatatttcatgaattgaagtgcagaacacaataacacaagaaagcagaataaaattaaaatgtaaaaatataatagtcaattatttaatataagaaatataaaatattgtttatgaaatattctcgtagtagtctatgtgtttcaacccaattgtcttctagataagtttcactaatttatactatcagtagtggtgatttggcaggatacctattttccttaaaccttatgtattactaaactttttgacattggcttatgagttagaatttcatttaaagaatatttcatttatttatgaattagatggagcgtcatttaatatacttaaaagctatttacattttttgatatattgccatttatatatctgcccccccttttttttttaccatttattgtctttattttccacatctaccattgttccaactatgagatactggcaaaccctcaccctttgaaaaattctttattttttaagagcagttttagtttacagcaagattgagagaagggtacagagatttgccacacaccctctatcccttcccagatatatatcctctcccattatcaacatccaccaccagagtggtacatttgttacaaatgatgcacttacattgacatgtcatagtcactcaaagttcatagtttacattagggttcacgcttagtgttgcataatatatagatgtggacaaatgtgtaatgccatacatctatcattgtagtatcagacagagtaatttcactgtcctaaaagtcccttgtgctctggtattcattcatttcccaatataacccctggctacctctgatcttttagtgtttccatgattttgccttttccagaatgtcatatacttggcatcatacagtatgtagactttccacactgacttctttcacttagtaacatggatttaaggtttctgtttctttcatgtcttgatagctcatttttttttagtattgaataatattctattttctggatacatcatagtttatttatccattcttcttctgaagggtattttggttgcttcgaagttttggcaattatgaataaagctgccacaaatatccctttggaggtttttgtgtagacgtgttttccactacttggataaataccaatgaggaaaactgctggatcatatggaaagaattttttttttttttaaaagctgccaaactgtgctcaaagtggctgttccattttgcattcccaccaacaatgaatgagagttcttttttgtttatatccttgctagcatttggtgttgtcagaggtctggatgttggccattcaaataggtgtatcatggtatctcattgttgttttaattttcatttccctgatgccatatgatatagaacaacttttcatgtgcttatttgctatttatatattttctttgctgaaatatgtgttaaagtcttttatccatttttttttggtcagactgttttcttattgttgaattttaagatgttttgcataacagttcttgatcagatatgccttttgcaaatattttctcctcgtctgtgttttgtctcccattttcttgacattgcatttcataagagcataactgttaaattttggtgaagtgcagcttatcaataattttttttccagagaacatacctttgtctttgtataagtcgttgccaaacccaaggtcatctagattttctcctacattgccttcttggagttgagttttgttttgcattttacatttacatctatggttgctttttgagttaatttttgtgaatagtataaggtctgtgtctagagtctagattaattttcttttctttttctttttctttttttttttgcctgtgaatgtccagttgttccagcaccatttattgacaaaactgtctttacttcattgtattgcctgtgctcctttgtcaaagattagttaactacatttatgtgcgtctagttctgggttctctattttgttccattgatctatttgtttattcttttgccaatgtcacagtgtcttgattattctagctttacagtaagtcttaaaatcaggtattgtcattcatctgactttattctcctgtaaaacctttttttgttttgataattctgggtcctttgcacctccatataacctttagaatgagtttatcaatattcacaaaaaattgctgggattttaattgagattgcattgaacctacagattaaactgtgaggaatgaacattttgacaatattgagtcttcctactcatgcacatgtcatctgggaacaaagttatacttctttttttcctaatctgtatactttttttttttttacttgtcttgttgcattagctaggactcgcaatatgacgctgaaaaggagtggagagaggcccatctttgccttgttcctgatgttagtaggaaagcatcagtttctcataattatgatgttagctatagattttggaacatattacttatgaagttgaaggaattccactctatttctagttcaccgagagtttttatcatgaatgggtgatgaattttgttaaatgctttttctgcatttattgataaaatcatgtgatttttctagagacttgaaaagttgagaagtttatagccgatagacacagactcattaaaagactgagaacaaattgtgggcctatagaacacttcctctcccctcacaccttaccaccatagcactaacagcctatttacagcggttccttttaccaagtatgtcatgtctggctatcaaataaaaaattacagggcgtattaaaagggaaaatacaattgaaagagacagaaaaatcatcagaaaaacacatcagggttgttggaactatcagacccaggaatttgaaacaaatatgccaacggctctagtaatgaagtagagagcatgccagaacagatgggcaatgtaacagagagaccgaccttctaagaaagaaccaagagaaaaaaaaagctagagatcaaaatacagcaacagaaatgaagaatgtcgttggctgacttattaataaactggacgtagctgaggaaagaatttctgaacttaaggatatatcagcagaaacatccaaaactgaaaaagtagagaaaacaaagactaaaaaacacccaggaaagagtatctaaaaatattcaaaaactgtggaacaactatagaagtatactatacatgtaatgggaatgtcacagggagaagaaagagagaaattaacagaaaacatatttaaaacaatgatggagaatttctcccaaaataatgccagatgccaaaccacagatctaagaagctcagagaacacttggtagcataaatgccaaccccctccaaatcctaagcatatcattttcaaactagaaaatcatagacaaagaaaacatcctgaaagaagctggcaaggggtggagtgggggaagtgccttacctatacaggaacaaacacaagaattacatccaacttctcttcagaaatcatgcaaggaggagaaagtatagtgaaatatttaaggtattaacagaacaaaccaccaacctagaattgtgtacccagagaaattatccctcaaaagtgcaagagaaataaagacattttcagacaaaaattggggatacgtgttgccaactagccctgccttgcaagaaatgttaaaagttctttaaagataaattaaaagttcaggtttcttctatggcagagttgtgtaaatatgaatacattcaaaatataaatgtataaataaagataaacctcaagtaagtctcagttcaactacagaaaaataagaaagtgcttttatgagatatttagctaaaagtgcaattcctgtttgtcttttgcacactagtggagactgtcccataaccagagaacccacttgcaaatttgaaaacctaattagcttccttctcagaaacactctgcttattcttacatttatcagcttctgagaacatgacagcaggtgtaagaagcttctccatcagtaatccaaactcggtgcctgtcattgtaaggaatatgcaactgatgctggagaccagggatttcattcctgcttttgcagggacgaagtgagcttgtgtagaccatgatctctctcctgaatctacgacaagaattctgctactgcttgatgaaaagggggtcactgagaactctggattttttaatgcttatttgattccaatgagggggcaagtaaaggcctgatggttgctctctctgaactcggtaaaacattgtaaaaatagtacatgaaaataaaataatacaattttattattgtcttgtaagtgtgcagaaaatgatactctgtcttagttttcccttagtcgtatcaaagtcttgaaaatttagcctttaccaaagcatttccttttccatctaggcataacacttctgctctaaactcatataaactattagaacattcctcaattaccacaaaaaatccttcaatttcctagtaattagtcacagaagaaagctattatgataaaaacagatggtatttgttctagcatataagtgaataatttatgtttcatgagagtagaagtcaagcatcaaatgatcaaagctgaatagaatttttagcagtaggtttttcgtatcctcctctccaaatttcatcctctcctttcttgaaggggttgacaaagacaaagtgtggcctgcctgtgttctctctcagctcagtcactttcacgtctttgaaaccaaataatgccatggggctgagtccttctcagctgaatccatgaaaaatagttcatcttttcacaaactggtaaacaagtgaagcatttcaattcacacattgggaatgtcaccatttaccatgtgatttgttgattagggaacaaaaaggagaggtggtgaagtgagcagttaagagtaagaatttaggagcctgtttgcctgggtttgaatctgatcttgaatgcttataactgtaaaatcttggctaagttgcttaactttctgactaccatttgttgtggggattaaatgaatatatatatttgaaattctggcccatgataagtgctcagtaattgttagctgattataaaagctgctataaaatcttctataatattgagaaactaagaagtcacttgtgttcagggagagaaaaattaccatttcggtagttaattatttagtaaataagcaagaaaagaagaatacatgttgacctaaaataataatgaagcccttatatgtacaatgtgctgtatcaggacatttgtctactgatagcagtataaattattgcttttacctggaaagaacttatcagaaaaaatttattccataaattgaggaacaagataaaatacataaaaacttaaccaattgttaaaattataagtatgtggacaattaagttttaaaggtattttcaggaggagatcactgtgttacagaaaagtcaaggagaggcatcatggggaaatagaaaatttaatcaggctttaaaggacagacacacatcaaatttgttcattatacaattatttcttaaataggcaacaggggtttttgtaggtttgatgaatagaataataaacaaaatagacaaagtcagacaccagaagagcttacctcatgaggctcgagtctagctttgtctacagtgttcaactttctcttacagaaatatcctatgaagttttcgttctaacatagatattgctcttgcttaccataataattggcctgttttatgtgatgattaaaaggtaaggtttttttgttttgtttttggaaacaggtatcactacgttgccaaggctggtcacaaactcctgggctcaagcgatccacctgtctcagccaactgagtagctgggactataggcccacactaccacacctggccaaggtctaagtatttaagtgctgtatctgtcacttactaaattatgtggccatggacaagtacttaatttagagcatctacacatcatcaattttaataacatacaacttaccacatgattgtaaagattgaattaaattaaatgaatttaattacatgattgaatttagtcaaaaataatttttcagctgatgatagttattctggaatgtggatgaaatgttgataaaacagaacataagataaaataactaaaaaatttaagtatagattaaggtttagctttccactctcctgctattgattatattattttactatggttaaggctgagtcaccctttatttcatattgaccttattccatccaattatttgaactgactgtaatggctttcttgtttggtttctttagttcacaggttttatgcacagaatgaaacattcttgcccctggtgtaacttaatgtaaattctaagatgaattcacatgagccttatggagcaggtgtcagatataatactattatattgagctatggtgccaataattagatccgtatctgggggctcatttaacaggtttctgcattgaaaggagagaaaataacctttctaggctttccttggggaggaatgctttttggatattcaatttatgacttgtacatacatggtagatgctcaggaaggattatagaagaaaaaaaggaaggacaacaatctggcagacaaacaagcatcactctccaacaaatcagcacctggtcctaccaaggtccttttccatgttacctcttcagacatcaggaggagctgtgttatctgtgcatgggggaatggatcttgtttgtggttggctgggaggactctcagcttcctgtaataacagaactatgaatattcactcagagaaacaagctattggcttggtagtgtttgagggctcccagaccccaaccagagtccgcagtaagtctcatggataaagtggagaagcccttgggagtttgtggagaagcccttgggagttttgttcttgattttctcttggcagctgtgctgtgagttttggggctctggaaatatcattgaaaagagcagtttgtagtatcttctttaaaagtctgcacttggacacaggaaggggagcataacacaccggggcctgttgtggggtggggggacggggtagggatagcattaggagatatacctaatgtaaatgactagttaatgggtgcagacaccaacatggcgcatgtatacgtatgtaacaaacctgcgcgttgtgcacatgtaccctagaacgtaaagtataataaaaataaataaataaataaataaataaataaataaaataaaagtctggaagttatagaagggtggttagggcctctgtgctcacctgtggggacttgaaaggagagtatatcttccaaaagtagtcagccatgaatgaatgtcctctgtctgtggttctctgtttaaacaggggtgaacagcctccatattctggagtagagtccttcattcattcctgagtatccgggagggaatgcacaacattcttaattgcacttatgaggagagaacgttctcttaacttctactggttctggcagggtctggaaaaggacttgtgtctttgaccttaattcaatcaagccagatggaggagggagacaaacattttaaagaagcgcttggaaaagagaagttttatagtgttttgaatatgctggtctctcatcctggagattcaggcacctacttctgtgctttgaggcacagggtccccaagcacctgcagcctgtaccacaacctgcatccgggacccttgacacagccttgccttgcaggtgggagtgaaggtgttgtctttatatgtagagagaacttctttataaactctgtctccaaacagaagcgaagggtagtgcagaatctttcttatgtgatgaagctgaatttatattaaattaaattgcattttgttattattgaaatttcattcttcaatgtagattgtgctgtgctggttctgggcctgtttgcccaccgatcccttccacagctctgtcctttactctaaagtcgcagaccactgtggcacaggctctgaggccaagaggcaagttttctccgtgctatactctcaccaacagtattttacccatttgcttgtaaattcatgatgtttcttgtatttgtatcatctatactattatttacttaattaaatgttaaattaacttttatgttgagtagacttcaaaactgtgtaaaatattgttcttattttaatggatactatcagtgaaattatattttatataaactatacatctgatgtgcaggctatgtttgttcctgatacaaactaaaataacattacatgtataacaattaaaaagaccatctgtgtactgcctaacatgacctcctatgttaaccacaatttagaaaatactgattcagctcatgtccctcatttaatagatgaaaaaagtagaatcaacagggacagcatcacttactcaaagcatgaattacagcaaaatggaagctaggaatggaacacagacattgtggccccttgtcacttgctttttccatgaaggatgtaaagtaggattcagtgtttgaaaaaaggagtggtatgttgtaattttaaactaaattatacttttattacttaattatatgttcattagaataaattaggagatataaacacccagaaaacatagaacactcctataatttcataacctagaaatgatagctattcacatgcaataaaatttttggtgcacatgtaaagctatatttttgtataaatgtggtttataatacatcaagtatttattagcacacttttctttcaactttatatttaggtattttcaactcaggaagcaaatattgaagaataattttaaattattgcctagtttccattacataaatatgcttttttaaaaactcttttttttggtattgtttctacttatacagtattacagataatgtttttattaacatcattaaaggtgtagttttaatggaagtgaagttgctggaataaagaaaaacacatgatactgaatcccttatttccatggagctatttctcaccaaactgtaatttcaacagtagcacatgatgatgctaattttccaatattttaccaattgtaaacattattattttagattagcttccattttgttaagtaaaatattgttttttattattcttttcttttaatttgtgattttatacctttgattattaaaataaataaataaaatgagatgagaaaacatcagatgccatcacacagaacaggtatcctttcatacagtaacatgtgttttttgaaagtgtgaaaaatactgctttggtccaagctaccttctaactggtctctcttttctcaaggcaatcaattctctatgtccttgctacttgaagtgtgagccagcattgtctgaacttgtactgattctcaggctctaccctaggctgattgaatttgaatctgcattttatcaagatttccaggcgattctatcacatcaaagtttaagaagcacccatctgatgagttgccagaatgattttttaaagtataaataaagagctttctccacttgtcaaacgtgcttcaatggctttctactgctcctggaataaagtgtggtggctttcaggctgtgatataaaaggatctatataattggaacctcccttggccctttggctttaaattctcttttcctggctctctgtgcagcaaaacttctgattctctttcccacatgtaggctctctttcatccatctgaaatgctctttccctaaatcttgttgagcctgactcaacaagagtcatccttcaggtctcagctcaaatgttactactgtagaagaaaaacctactgacctctgctactcttcctgactaatatatctgtctgtaatcctccccctaactctgtcagaacactctagttatttctcctatgttatttatcgtaacttacagttacatttttggtttatttgccagtatgttcattggccataccttctattagaatgcaatctttatgatatcaggggtattgttggtttagttcatggcttgattctttttgtttgtttttctttttttttttccaatttttattttaggttctgagggtacatgaaaaggtttgttatattggtaaattgcatgtcacagggacttggtggagagattattccatcacccaggtaatgagcatagtacttgataggtagtttttggatcttcaccctcttcctactctccacctccaagtaggccccagtgtctgttggttccttctttgtcttcatgtataatcaacgtttagctcccacttataagtgagaacatgcagtgtttcattttctgttcctgtattaatttgcttaggataatgccctttaactgtatcgatgttggtgcataggacatgatttcattcatttttatggctgcatagcattccatggtatatatgtaccacatttttttccagtacaccactgatacgcatctagattgtttccatatctttgctattgtgaatagtgctgcaatgaacatgtgtgtgcgagtgtctttatggtagaatgatttatatttctttgagtatatacccagtaataggattgatatgtctgatagtatttgttttatgttatttgataaatctccaaatggctttccacagtggctgaactaagttacattctcaccagtggtataaaagcattcccttttctccccaaccttgccagcatctgttattttttttactttttagtaatagcctttctgattggtatgagatggtatctcattgtggttttgatttgcatttatctaatgattaatgatgttgagcattttttatatgcttggtggttgtattgatgtcttcttttgagaagtatctgttcatgtcgttttcccattttgtctgttcatgttgtttgttttttgcttgttaatttgcttaagtttcttatagattctggatattacacctttgtctgatacatagtttgcaaatattttctcacattctgtaggttgcctgtttactctgttgatagtttcctttgctgtgtaaaagttctttagtgtaattaggtcgcatttgtcaatgtttgggtctttttgcaattgcttttggagtctttgtcatgaaatctttgcaaggcctccagaatataatttcataagttttcatctagggtttttatagttttaagttttacatttaaatctttatttagtccatcttgaatttatttttgtatatggtaaaacaaagagatccagtttcagtcttctgcatatggctagacagttacaccagtaccatttattgaataaggagtcctttactcattggttgtctttgttggctgtgtcgaagatcaggtgatcataggtgtgtggctttgtttatcggttctctattctgttccattggtttatgtgtcgatttttggattattaccaaggctaagttttggttacttagctttgtactagaatttcaagttgggtaatgtgatgtctccagttttgttccttcttttgttaaggattgctttggctgttcaggctcttttcttggttccatttgaattttagaatggtttctactaattcggtgagaaatgacaatgataatttgataggaatagtgttgaatctgtagattgctccgggctgtatggacattttgatgacactgattcttccaatctatgagcatgaaatgtgtttccatttgtttttgtggtctatgatttctttcagctgtgttttgtaattcctattttaggtatctttcacctccctggttagctgtattcctagataactttttttgtgtggctatagcgaacaggattgtattcttgattttgctctcagtttggaggttttcagtttatagaaatgctacttattcttgtacgttgattttatatcctaaaactttgctgaagttgtttattaggagccttttagcagaggccatgggttttctaggtaaaaagtcatatagtctgtgaggatagagattttgacttcctctcttcctatttggatgccatttatttctttctcttgcttgaatgttctggctaggatatccagtactatgttgaataggagtggtgagagtgagcatctttgtcatgtttttgttctcaaagggaatgcttccagcttttgcttgctcactataatattggctgtggatttgtcatagacggctcttattattttgagttatgtttcctcaatgcctactttgttgaggagttttaacctgaaaggattttgaatttcatcaaatgttttttatgtctattgaggtgataatgtagttttttttttttagttcagttcatgtaatgaatcacatttattgatttgtatatttaaacaaccttgcatttcagaaataaagactacttgattgtgctggattagctgcaggatttggtttggtagtattttgattaggatttttgcatgtgtattcatcagggatattggcctaaagttttcttcttttgttgtgtctcttctaggctttggtatcagaataatgctggcctcatagaatgaggtaaggaggagctcctattcctcaatattttggaatagtttcaaaaagtaccagctcttctttatatgtctggtagattttggctatgaatctttctagtccagggcttttttcttgttgtaggtttttattactaactcaatttcagaactccttattggtcagttcagaatattgatttcttcctgagtcaatcttgggaggttgtatttttccaggaatttatccatttcttctaggttttctggtttatctgcatagaggtgttcaaaatagtctctgagggttttttgtactgctcctgtgacatttctgattgtatttatttggatcttctctgtttttttctttattagtctagctatcagtctagcaatcatttttattctctcaaataaaaaccatttggttttattcatcttttgtatggtttttcatctccatttcattcagttcagctctaagtttgttatgtctcttcttctgccagctttggggtgggtttactcttgggtttttttagttactctagatgtgatgttaggttggtaatttgggatctttctaactttttgatgtggatgtttagcactatgaactttcttttcaacactattttagctgtgtctcagtgattctgttatgttgtatcttttttttcattagtttcaatgaatcccttgctttttccttagtttcactgtttactgaaaagtcattgaagagcaggttgtttaatttccacataattgtatggccttgagagatcctcttggtattgatttctatttttattgcagtatagtccaagagagtggttgatataatttggagtttttttgaattttttgagaattgctttatagtcaagcatgtggttgattttagagtgcagataagaagagtgtgtattctgaggttgttgggtggagtgtcctatagatgtctgttaggtccatttggtcatgtgtcgagtttacaacccaaatatctttgttatgtttctgcttcaataatctgtctaacactgtcagtggggagtttaagtctaccagtattattgcatggttatctaggtctcttcataggtctctaagaatttgctttatgaatctgggtgctccagtgttggatacatacttatttaagatagttaggtcatcttgttaaattgaacacttatcattattcattatttaatgcccttccttgtgctttttcatcattgtatttagaaagtctgttctaactgaaattagaaaaagtaacctctgctctttttggttttctatttactttgcagatttttcactgtctctttactttgagcctatgtgtgtcactgcttgtgaaatgggtctctaggagacagcatacagttgggtcttgcctctttatccaaattgctaccctctgccttttaaagtgggtcatttactctgttcatgtttaagtttaatatttatatgtgtggatttgaccctgtcttcgagttgttagctggttgttatgtagacctgattgtgcagtttcaccaggtgtggtgggtgatgcctgtaattccaacactttggcaggacaaggtgggcaaattgcatgagcccagtagtttgagaccagcctgggtaatatggcaaaaccctgtctctacaaaaaaataaaaaaatttagctgagtgtgatgctgtgtgcttatagtcccagcaggctgaggcaggaagattgattgagcctgaccagtcaatgctgcagtgagccatgattgtaccactgcactccagcctgggtgacagaatgagaccctgactcaagaagaaagaaagaaagaaggagagaaggagagaaacagagaaagaaagaaagaaggagagaaggagagaaacagagaaagaaagaaagaaggaagaaagaaagaaagatagatagatggtggagctgttttacagtgtcaatggtctgtcttaattgtgtttttgtggtggcttgtagcagtcttttttccccatgtttaagcattcctttagggacctcttataaggcaggcctggaggttacaaatttatttagcatttgcttgtctgaaaagaattttgtatttcctttgctgataaagcttagtgtggttggctatgaaattcttgtttggaatttattttctttaaggatgctgaatataagcccttaatctcctctggtttatgaggtttctactgaaaagttcactgttatcttgatggggtttccttagtagatgaccagccccttccctctagtggcctttaatattttttctttcccgttaaccttggagaatctaatgacgatgtgtcttggagatggttgtcttgtacaatgtcttgctggggctccctgagtatcctgaatttgaatgttgaccttcctagtgaggttgggaaaatttttatgggcaatattctcaaatatgtttcccaagttcctttctctttctctctctctttcagggatgccagtgaattataaatttggtgtctttacataatcccatatttttcagaaatttttgttcattattttttattcttttttctttatttttgtctgactgagttgattccaagaactattctttgacctctgagattctttcctcagcttgttgtattctcctgttaatacttaacaattgtattataaagttcttgtaatgagtttttcagctctatcagaacagtttggttctttcttaaaatggctattttgtctttcagatctcatattattttatttctttacattgtttagattccttggattgggtttcaattttcttatgaatctcaatgttcttacatccaaattgtgactgctctgtgtgtcatttcagccatttcagcctggttaacaaccattgcctgggagctagtgtggttgtttggaagtaagaagacactctagcttcttgaggtgccaaagttgtcgtgttggttatttatcatctgtgtaggctgatgatcctttaatatttgaagttcttgtcctttgaattttttttttacttttatattattttatgcccttgagggatttgactgtggaataagttgcgttcagtcaactggcttcatttctggatgatttcaggggtcccgggttcagatgagcattcctgcactgcatgctctaaccctatggggttgggaccaggcccacttctttgttctctggcccctttaggttaagtaccgactgaactggaggggctgaggtgttactggtttgctgacatcaacactccacttgggggtgctggcaaaagcacttcattgaacttgtggcagcaggatcagggctcatgtacacctgtgccaggggcaatggcgggagggtgtggatatgtgtcagcagtggcctgtctgcagaagctctctgatggttaggcagagtttgctggtgaagtagctatgacaccagtcaccaggaagtgccctggttggacacctaacgcagagttgcaagtaggcatggtcaggtagggaccctgggagaggtcggcagacaagggggtgctcagatcagactagtcctgacccatgggcaagacacctctactctgtccaggtctgacagtcaacaaaggctagagccacgtagaggagcatggtgcaccttggggaataggcatccctactgggctcactgcctctattcccatgctaaacactctgggcttcacacaggctagagtcctgtcactgccagcactccaagtagctctccctgccagctcaaatttctatgggcatcatggggtctcctgcagttaggattcgagaggtccatgggaggagttagcaaatgctcacctatctaattcagcctttcctctggagacattgagcgtcatgaatgagtcccagtgcttggcagccctgtgcagggttcccgggttcctctcactttggtccagggtctgagtcttgtctccatccattctcaatgcattctttctgacgataccctcagagaatgcaagtcttcctgatggtctgatctcttggtaggagaagctctttctagctgtgtctaattgacgatcttggagctcctcttcctggctttattcttagtgtctagaataatgactagcccatagtaatcggtcaaaaattctactgagtgaatgaagaatgaaatttgtttggccctcccctctttctcccttttcccttcctctcattcccactctagcaactttgacctttgtgtatgttgtctctacttcactatgtggggcagctcaattttctctggccctcacccccagactcagaacccagtctttttgtacttagtggcttctgtcaaatagattcactcagggcctcaacctttcctcacttaattgacctcaccttatcagatgtgatgtgaaggactgagtcaactcttaaggctagtaacccatagcgaaatatctaaaagaaaaacgacatacttaaaagatgtttggaaagtataaaagtaacttctcaagcctaataattatgagcacatatcaaagttttatttcaaattactgcaagagaaaaagctcctcaagaaacaaattcaaataattagccttggtatattgttacaggaatccagatttttaaaaatctggttaaagatcattattgcattcaaatgacggttgcataattaccctgcttttgactgcctgtgtagtgactattaggcttctcacaagattaatggtcatttgagtttgtaacactaatttcccagaaggaatctttatttcattaaaggatattagaaaattgctcaagcgttttattagaagtgatggttaattaccacatggggctatgtatattatatcctccgaaaaatgcctgcttcataccagtttggagaaacttacctttctcagctatgtatgttatatccttcataaaaggcctgtttcataccagtttggagaaacttacctttctcatgtgtaatttaaatctttactttacaaatctttacaactcctttagtgaggatttgtcaggtcttggattttgtcccttcttacaagctaataagcttgtttcattgaggctgtcaataaaaacacagggctccttagtaagagacaaaggatttttattacttatggcacaacaaacagcatgaacactgatatatttccatcagtttctccttcctttaagtcctcaaaagatgatgtaatgggtagtaagggatgctacccatgaagtggtattatgtcacaggtgaggaactctgagcttaggaagttcattgcttttataacaagcactcagccagcttgctctttgtctcagagggagacattacctcatctcccaaggttgcttgctggcataactctgagaagtgatccaggtagaatgctcatgtcattacactgttggcacactcatcaagtcacgtttgagtacaagagactcatggtggactgcctttcaataatatccactccatggtcttacactgggttagttgctagaaatttattttatgagtatgccactttgtcagtcattctgatttgtgtaactgagagatgtcatgactaaatgcattacatttgtctcaagtagcatttaattaaggctactatcagcagaactctaagaagcagaatgagaccaacatgcagtattaaccttaattatgcttgatccagccaaatgtgagtaagttccaaagtacagacagctagcatgtagtattttatctattataacccatacatgaaagttcagactgaaatgttggtctttctttgaattaccacaaagaaaaaaccctaccattcccaatatagagatgttatatggcccctttcccccgggcataacccaaaatgcacaagttaatcaaatttgggatttattattaaacttgatttggataagcattgcatcactttggttaaactacgtgagcagtgtcagtgagtatttgcaatatttgcaacctctgtagccattcatgacataacccaactgtcaagatatcaggggaagcatatacatttgtgtcagtcaatttgagacaaggttgtgctgattcttgtgtttgtatacttatgaagatggggaatctatattggaaagctgccactgataaaatagtctgggagccacattcacaagagttttcctgttttcttgggatgtgggaggagataacaaaccaatagcaggacacagagttgctgcttggctccagaagacaatatgtttgtttttctatacttgttctagcatacaaagagagcattagaccctcacttctccccactggccagggtctaagagtttctcttgctatgtgctcatcatcactaatcatcagagagatatccatcaaaaccacagtgagatatcatctcacaccagtcagaatggctattattaaaaaattataaaacaacagatactgttgagactgcagagaaaagggaacacttatatgctattgatgggaatgtaaattagttcagtgcctgtggatagcagtttggagataccccaaagaacataaaacgaagctatcattttacccagcattcccattgttggatatatatgcaaaggaaaatagattgttgtaccaaaaggatacatggcttcttattattattgccatggtattcacaatagcaaatatgtggaataaaactctgtgcccattgatggtggattggataaagaaaatgtggtacatatataccatggaatactatgttgccacagaaaagaatgaaataatttctttgcagcaacatgaatggatctggaggccattatactaagtgaattaatgcagaaatgttaaaccaaatatcacatgttcttacttataagtgggagccaaacacagaacctacgtaaacatggcaacaactatggattaccaaagggagcaggaactggggggtgcattaaatagtacctatcgagtactatgctcaccacctgggtgtaatatacacatgtaacaaacctgcacatgtacctcttgtacctaaaatataaactaaaatatttaaaaatagactcaaaattagcaccattttcagaagcgtttattttaagataaattgcttttaaatgaaatcttgttttgcaatactctgaggttcacaagacatatctagaaaatgtactattgcggaaggtgaagacggtgtaaaaccagtgggggagaggtcagtggtttttcttattggttgattatcagaacactgtcctttggggatatgaaagagttttatatattctttagacataattagacaaacaatggtccatagggcaggtttgatgctgtacaaagtctgtcattttgctagcactgatatggttcttgggtccaccacagcattagatctgttgatgcatttatattatgctttgttacaaatcttgaaaagaggggtgcttcttacagactttgcttcagatattagattttgttttagtaaattttccaagactgtagtggctgccagcttgtgttactttcacttttcctctggtttttgtatttaccgagaaatggtcatggtttctgtcaagtgcaatgtacccttggagaaaggaatttcaatattagcatctattccctcattctatttcctaggtagttgttggtgggaatgggaaaggttagcctcagccatctttggtgaataccgattacatggctcttgagtggaaaaaagcctgcttcattgttggcctcttcaaggacatgaaacacgttgtggaacagaagagaacagtagttgtctgtccttgtttatctatagactcaattgagtttcttgcatagatagctccctgatagatttggtttgctggttatgtcaggatgaacaaaacctataacttttagagattgattcctaggtatcagctttatacaagaaaggcaataagagggacaggacaaatgaacaggcacattgggttttattgacagtctaggtactaaaggcaggttcatctcaattgcaccaacccaagcaagagctgttttggcacagatgcatcattggtgcaaaatggaatgacaaagtccaagctcctccagttcctggccttgttaaaaaatattgcttaggctatgggctgcaaccatgtttgttttgttcagctagattttaggccatttcatcttggaagacttattttgagttataagaaatttctttaaaagttgtatataacagagtagtataggaatatgtggcctgacattaagaagagctatacagtgtgaaattctccctgaattgcaagaatctcactcagatttctataatagaatctgttatgtctgattttttagttcaggaaagtggctattagaaataagtggtcttactgacccaagagttgccatttgatggaaactcatacacacatatatacccctctgcctttctcacacatacattgactttgacttttaatatagcttaaaagctttattaaaagtttttatttttaattgattcataatatttgtacatatttatgtggtccatgtgatattttgttaggtgcatagaatatacaataatcaaggcagggtgtttagaatatctattaccaagagcacttatcatttctgtattgagaatatttcaagtcctcacttctagctattttgaaagtacaatgtgttgttgttaactttagtcattctactctgctattgaaaattagaacttattccttctgtttctacccactaaccaacctccttttattcccccaaccacatccatttccttcccagtctctgataaccatcattctagtctctgtctccctgagatcaactctttttttttagcttccacctatgagtgaattcatgcaatatttatcttcttgtgcctggcttatttcatttaacataatgacttccagttccatccatgttgctgcaaaggacacgatttcatttatttttatacctgaatagtattccattgtgtaactatacaacattttctttatccattcaccagtagatagacactttgttgatttaatatctttactattgagaatagtgctacaataaacatgaggaggcaggtatgccttcaaaacacttctttcctttggataaatactcagtagttggattgctggattgtatggtagttctattactacatttttgagaaatttccctactgttttccagagtggctgtactaatttacattcctaccaacaatgtttgagagttccattttctatgaatcctcatcacatctattattttctatatttttaataatagcgattctaactgggataggatgatatctcattgtggttttgattcgcatttccttgatgattagtgatgttgagcatgttttaaatacctattggctatttgtcttcttttgagaaatgtcaatttagatcttctgcccatttttaaatgggattgtttgacttttttttttgctgttgagttgtttgagttccttgtatattctgaatttaactaaagtgtcatattttcacttttagcagttcacataacacaggtctgtagttggaatacatctttgatcactttcatgagtcctcaagatggcagtgtcttctcagggaccttgaggcaagctctcatgtgctcctgcggtggggaggggaggggatgcatgtgcacttgcaagtgcacacacacacatgaataagagcaagacagagggagagatgagggaggagcttaatgatggagcagaggtgttaaaaagaacatcctttttctaattggtaggacagatttcttttatgattcctacagcagaaaaatgagaaacgtttgttattatttttttttcgtgtttaaggtttgaatcctcagtgaaccagggcagaaaagaatgatgaaatccttgagagttttactggtgatcctgtggcttcagttaagctgtgagttttgggcatctctgtagaaacataatgtatattgtttgcaattattgtgtattctaggcctgtgggtagaaacatgagtggttttttctctaacaaagggagactggggagagtggggggcccatgaaaagatgatttaaattctgggtacgaagtgtcccctacccaatctgtcttctctgtctgactgctgtcttttttcacaggggtttggagccaacagaaggaggtggagcaggatcctggaccactcagtgttccagagggagccattgtttctctcaactgcacttacagcaacagtgcttttcaatacttcatgtggtacagacagtattccagaaaaggccctgagttgctgatgtacacatactccagtggtaacaaagaagatggaaggtttacagcacaggtcgataaatccagcaagtatatctccttgttcatcagagactcacagcccagtgattcagccacctacctctgtgcaatgagcgcacagtgctccccagacacttgcagtctgtacccaaacctgctgggccccaggaatgcctgatgtagagcttagactgcaaggcaatgaagttctatttgttctctagatgcaaatgaaaactaaaagcagtagtattgaaggtttgattaatttgggacatattttcataattctgaaaattattgagaccccaaaggaaaataaaagacaccatttggtctacttgaaatattttctagtcttctctttccactttagttttgaaattttttttttgctgactttgtggctcatgtctgtaatctcaacacttttggaggcatagggaagaggatcacttaaacccaagaatttgagactagcctgggcaacacagggagaccttgtctcaaaaaaagaaaaaaaatcgccaagagtggtgacatgcacctgtagtcccagcaacttgggagggaagaggtgggaggatttcttgagtcggagaggtggaggctgcaatgagctgtgatcacaggactgcactccagcctggacaatggagtgataccctgtctcaaaaaacaagcaaaaacaaaacacaaaacaacaacaaaacacaaataaaatatttttattgaggtgttattgacacacaaaaaggtgcacatattcactttatacagacaatataatcgtgccataaacatatgtaccatttctaaaaatttgcttcctccctggtttctttttattaagttattattgctatacaaaaaggtacatttatttaatccatgcccagtctacttttatgccacatctttactttatgagattggttttatgattctttttatcaaagacaagaaaatatttccatacaataacagatatgctctcatggttcctaagacattttgctctttccccaaggcatttgatagacattgctttaagaatgaaacagcaaagcagaaatgcaaagagaagaaaaatcataagcagactaatttgaaaatccggtaagtcataaattttttaagttacagaaccctaactccatctccagcctcaactacaacatcactcctgagttatataagggtacacctgatggacagctggaagaactagagtgagagagtgagaactggttgagaaaaagcctaattagttgcacaaactaaagattagagagggtctatgttgccattttggggtaaagttttaatcaaattcaaaactcccagcttgagcctgatgggatagttttttgattcctatgtacttgagtgtggcctggagatgggaaggagcattggctgtagttgtagagtgcctcatctccccagcagggcatgacagcacagaaggacttaaaatttttttgagaagggtctctaagtatcttaaagagatccagacaccaaggtcctttgttatgatgagtaaagacctgtatgaataagataccaaagaccgtatggaattgagaatgcttcaggaaatgtttgtctggagagttggaaacactaaacatcatatgaatatctccatcccctgactacaaggcaccacagatttgccctgcagtgtatgtcaagtatggggaaagcatttgtggcctgacgaaataaggccttttagtagacattactttgaattacaggcaaaatatttgagaatcatatttactgtaaaaatgaagttgtggtctgataggcataacattatttatgtagcccagaaggtgggaaaagcttggaaatgaagaataaatgtttctgtccagttttattgacagtcactgatgaaaatgatgaagccaagtcagaatttgctgcaacttcttactctgcagaagtgaagactctgaacaaatatttcccagtcatagaagaaagatttaaaaagcaaggaggaagagcaaacagttgtgctggaatcaaggtacttaaatttttattccacttttatgatttgccttctggcatcatggcactctggaaagaactcaggctgtggtgctggtttgaacatcgattatattacttatggcctttttcatattaagctctacaattatatatatttcaggactggtttcaggattccgtgagacaaaatattgtcttgggatgagttccttaaaagcagagactgcatttggaattctctgtctgtaatttatttgggaaaccaggttgagatgggggaaaggctggacatgagggggaaaggttgagatgctggacatggtccagcagaggtcttgatccagcctgacctcatggggagctctggagcttgaactgtatcacagggttgattcctcccaccctgaggcaaggaggccagactgctcggacctattgtgggtaagaataaagtcatcattggttgtggtgtttcttggggtagaggtatatgctactggacaatggtgactctcattggctaaggtcaattttctagggaaagaggcaactgtgagccaagagtagccaacattcacagtagctggggatggctacactgtcctaggaaaggggatctagcttggggaccagcagtgctcattattaacatggaacttgcctggtatgtgggtagcatttgagaaataatagactttgagcagaataaatgatatcagagattgaagatcaacttactgaaataaggtgtgaagacaagattagagaaaaaagaatgaaaaggaacgaacaatgtctccaagatatatgggactctgtgaaaagaccaaacctacgtttgattggtgtacctgaaagtgacaggaagaacagaaccaagttggaaaacacacttcaggatattattcaggagaacgtccccaacttagcaagacaggccaatattcaaatttaggaaatacagagaacaccattaagacactcctcaagaagagcaaccccaagacacataatcgtcaggttctccaagattgaaatgaaggaaaaaatgttaagggcagtgaaacagaaaggtcaggtaacctacaaagggaagcccatcagactaacagcggatctctctgcagataccctacaagccagaagatagtgagggccaatattcgacattcataaagaaaagaatttttgacacagaatttcacatccagccaaactacgcttcataagtgagggagaaataaaatcctttacacagaagtaaatgctgagggattttgtctccaccaggcctgccttgcaagagcttctggaggaagcactaaatacggaaaggaaaaactggtaccaaccactgcaaaaacacaccaaaatataaagaccaatgacactatgaagaaactgcatcaactaatgtgcaaaataaccacctagcatcatgatgacaggatcaaattcacacataacaatattaaccttaagtgtaaatgggctaaatgccccaagtaagagtcacagactggcaaattggatagagtcaagacccatcggtgtgctgtattcagcagacccatctcatgtgcaaagacacacataggctcaaaataaagggatgaaggaatatttaccaaacaaatggaaatattttttaaaaagcaggggttgcaatcctagtttctgataaaacagactttaaaccaacaaagatcaaaaaagacaaagaagggcattacataatggtaaagggatcaatgcaacaagaagagcgaagtatcctaaatatatatgcaaccaatacaggagtacccagattcataaagcaagttcttagagacctacaaagagacttagactcccacacaataatagtggcagactttaacaccccactgtcaatattagacagaccaagaagacagaaaattaacaagtatattagggacttgaactcagctctagaccaagtggacctaatagacatttacagaactctccaccccacatcaacattcttctcagcaccacatagcatgtattctaaaatcaaccacataatgggaagtaaaccactcctcagcaagtgcaaaagaacagaaatcataacaaacagtctttcaggccacagtgcaatcaaattagaactcaggattaagaaactcactcaaaaccacacaactacatggaaattgaacaacctgctcctgaatgactactgggtaaataacaaaattaaggcaaaaataaataagttctttgaaactaatgagaacaaggagacaatataccagaatctctgggacacagctaaaacagtggtgagagggaaatttatagcagtaaatgcccacatcaggaagtgggaaagatctaaaatcgacactctaacatcgcaattaaaataactagagaagcaagagcaaacaaattcaaaagctagcagaagacaagaaataactaagatcagagcagaaatgaagtagatagggacccaaaaaacccttcaaaaaatcaatgaatccaggagctgtttttttttgtaaagatcaacaaaataggtggatgactagccagactaataaagaagaaaagagagaagaatcaaatagacataacatgaaatgataaaggggatatcaccactgatcccacagaaatacaaactaccatcagagaatactatgaacacttctacacacaaaacaataggaaatctagaagaaatggataaatgtgtggacacatataccctccgaagactaaaccaggaagaagtagaccaataacacattctgaaattgaggcagtaattaatagcctactaaccaaaaaaagcctatgaccacatggattcacagccaaattctaccagaggtacaaagaagagctggtaccattccttctgaaagtattccaaacaatagaaaaagagggaatactcccaaactcattttatgaggccagcatcattctgatatcaaaacctgacagagacacaacaaaaaaagaaattttcaggccaatatccctgatgaacatccatgcaaacatcttcaataaaatattggcaaactgaatccaacggcccatcaaaaagcttatccactacgatcaagttggctttatccctgggatgcaaggctggttcaacatacacaaatcaataaacgtaatccatcacataaacagaaccaatgacaaaaaccacatgattatctcaatagatgcagaaaagacctttgataaaattcaacatcccttcatgctaaaaactctcaataagctaggtattaatggaacatatctcaaaataataagagctatttatagcaaacccatagccaatatcatactgaatgggtgaaacctggaagcattccctttgaaaaccggcacaagacaaggatggcctctcttaccactcctattcaatatagtattggaagttctggccagagcaatcaggaaagagaaagaaatagagagtattcaaataggaagagaggaagtcaaattgtctctatttgcagatgacatgattgtatatttagaaaaccccatagtctcagtcccaaaactccttgagctgataagcaacttcagcaaagtctcaggatacaaaatcaatgtgcaaaaatcacaagcattcctgtatactaacaatagacaagcagagagccaaagcatgagtgaactcccattcacaattgctacaaagggaataaaatatctaggaatacaacttacaagggatgtgaaggatctcttcaaggagaactacaaaccactgctcaaggaaataagagagggcacacacacacaaaaagaaaaaaactccatgttcatggataggaagaatcaatatcattaaaatggccatagtgcccaaagtaatttatagattcaatgctattccatgaagttaccagtgactttctttactgaattagaaaaaactactttaaatttcatacagaaccaaaaaagagcccgtatagtcaagacaatcctaagcaaaatgaatgaagctggaggcatcatgctacttgacttcaaactatgctacaagtctacagtaaccaaaacagcacggtactggtaccaaaacagatatatagaccaatagaacagaacagagacctcagaaagaacaccacacatctacaaccatctggtttttgacaaagctgacaaaaacaagcaatatgaaaaggggaaagaattacctatttaataaatcgtgttgggaaaactagctagccatatgcagaaaacagaaaccggatcccttccttataccttatacaaaaattaactcaagatggattaaagactaaaatgtaaaaccccaaaccataaaacctctagcagaatacttaggcaataccattcaggacataggcattggcaaagtcttcatgactaaaacactaaaagcaattgcaacaaaagccaaaatagacaaatgggatctaataaaactaaaaagcttctgcacagcaaaagaaactatcatcagaatcaacaggcaacctacagaatgggagaaaatttctgcaatctatccatctgtcaaaggtttaatatccagaatctacaaggaacttaaacaaatttacaagaaaaaaaaccaaacaaccccatcaaaaagtgggagaaagatatggacacttctcaaaagaagacatgtatgtgaccaaaaaacatatgaaaaaaagctcgtcatcactggtcattagagaaaggcaaatcaaaaccacagcgagataccatctcatgccagttagaatggcgattattaaaaagccaggaaacaacagacgccggtgaggatgtagagaaataggaacacttttacactgttggtgggagtgtaaattagttcaaccattgtggaagacagtgtggtgattcctcaaggatctagaaccagaaataccatttgatccagcgaacccattactggatatatactcaaaggattataaatcattctactataaagacacatgcacacgtatgtttattgaagcactatttataatagcaatagcctaccgtagtaaatagcaatagcctaccctagtaaagtttaatattttgaatgaaatatattatgttgtcttacatatgaaaagaaaatctacaggcagaatcaaggaataggtcagaagtgcaagggagaactgatttcccactggcatgagtcaacagagtacacagaaaggaaggagtttgttttgacctttgaaaagaattcttgttagccggttcttatttcacctgagtttttttctttatttgattttttcaattttaggatccaatgatctctatgctaaaataagttgggtgaggaagtcttttcattcaagaatttcatcttcttaggccatagagttgactgctctggttcaatgcatcctgtctcccacccacaggggactgcttcttgcctagctctgttgagtatcactgtcaacctatcctaagtcttctatacctcccattttcttggtcatctcatttcttgtctgctggttgcactcctcccagctttactgagttcacgtaggcttacttttctttctgtatctttaattcttcccataattacttatttatatgttatattttattaccttcattattctgctcaaatttctccataaatgggcttctgttgatgttctttttaaggcgagataccataatttggcataatgtatcagtctattctgagcgttgataattcaaatgggacttttctctaagttttttctcctagccttacaaacatcaaacttgatttgaaaccaagaagtctttttcacaatttctgcttcacaaagaaaattattacctattagtttgcattgactaattagctaatgacacgtgatccaggctgattttaagtatgagtctctagtcattttttttttcctttagcacctaataaaagagaaatctcttccatccactctaatgctcatgtgaatccactagcacagtgccacacgaagcttagctaagcctgaggcaattgatcttctcccctctccttgatgagtgcctctaaaaaataacatagagcatcttaatggtattccaaaatctggaatattgccttctgtgactaatttctcagtgaagtaaattacttttctagttttacataactccaatttcttatctattttttgaggggaaaaacatttttattttctaatttttaaattttatttctttcaactgttattttagaatcaggagtacatgtgcaggtttgtaacagaggcatattgcatgatgctgaagtttggactatgaatgcattgtcgctcaggttgtgagcatagttcctaatagttttcagtccttttctccttccctctcttcccactctagtagtacccagtgtctattgtgactatctttatgttcatgtgtagctagtgtttagcccccacctataagtgagaacatgcagtatttagttttctgcttctgcattaattcctttcagataatggcctctagctgcatacttgttgctgcaaaggacaggatttcatttttctatggttgcatagaagtccatggtgtatatgtgccacattttcttcatccaatccaccaccgattggcacctgagttgattccatttctttgctattgtgaataatgctgtgatgaatgtatgggtgaatgtgtctttttggtagaaaattttatttgcctttgggtatatacccagtaatgggattgctgggttgaatgttagctctgttttaagttctttgagaaatctcaaaactaatctccacagtagctggactaatttatatttccaccaacagtatgtaagtgttcccttttctacacagcctagccaacatctattattctttgactttttaaaaaaagccattctgattggtgtgagatggtatctcattgtggttttgatttacatttctctgatgttaagtgatgatgagcattttttcatgtttgttggctgtatgtatgtcttcttttaagaagtctctgttcatgtcctttgcctacattttaatgcggttgctttttgcttgtcgatttgttgaagttacttttgtttctttcttttttggaaagacagggtctcactctgttgcccagactggagtgcagtagcatgatcctagctcactctatccttaaactccagggctcaagggatcctcctgctttagctgggactacaggcacatgccactatggccagctgatgtttttcttttccttccttccttcctcccttccttccttccttccttcttccctccctccctcccttccttcctctctttctctccttctctttctctttccttccttccttctttccttccttccttccttccttccttccttccttccttccttccttccttccttctttcctttcttccttctttccttctttccttctttctctcactttttttttttgagtcagattcttgctatgctgcccgggctggtcttgaacccctggcttcaagcagtcttccagcttcagccacacaaagtgtggggattacaggtatgagccgtcacacccagcttgttacttatagattctggatataagacttttgtcagatacatagtttgcaaataatttcacccattctgtaggttgtctgtttactatattgatagtttattttcctgtgcacaaactacgtaggtcacacttttcaagttttgttttggttgcaattgctttccaggacttaaccataaattctttgccaatgccgatggcaaaagggtatttttctgtttttttccccctaagatttttatagttttgggtattacaattaagtctttaatccatctggaattaatttttgtgtatagtgatgggttggggtccagcttcattcacatacactggtatgtggctagccagttatccccagcaccatttattgactagagagtttttcccaatttcttatttttgttgactttgtcaaagatcagatggttgtaggtgtgttactttatttcagaatttgctattctgttccattggtttatgtgcccatttttataccagtactatgctgttttggttactgtagacttgtagtgtagcttgaagttgggtagtgtgatgcctccggctttgtgcttgttgcttagattgctttcactatttaggctcttttggttccatatgaattttagaatagttttttcctaattctgtgaaaaatggcattagtagtttgataggaatagcgttgaatctgtaaattgctttgagtagtatggacattttaaagatatggattctcctaatccagggtatgcaatgtttttccttttttgtgtgccatctctgatttctctcagcagtgttttgtagttctctttgtagagatctttcacatccttggttagctgtattcctaggtatctattctttttgtgtctattgcaaatgtaattttgttctttagtctttaggaccctgctcaaggtcctgcagcattgccactgctgagccatgctcctgctgctcggcccagcactccagtgtcccagctgtcagcttgaacagacagctcgaacattattggtgtatagcaatgctactgatttttgcaaatttgttttgcatcctgaaacttcactgaaatcttttatcaagtctaggagcctttcggcagaaccttgagggtttttctagatatcaaatcatactgtcagcaaagacggataatttgactgcttctttccctgtttgggtacactttatttttttctctttcttgagtgctctggctaggacttccaatactatactgaataggagtactgagagtatacattattttcttgttccagttctcaaggggaatggttccagctttttcccattgagtatgatgttggctgtttgtcataggtggctcttattattttgtggtatattccttccatgcttagtttgttgagggtttttatcataaagtgatgttggactttattgaaagctgactgcatctattgacatgatcatatggttttgcttttaattctgtttctgtggtgaatcacatttattgattcgtctatgttgaacaaaccttgcaccccaggaatgaagcctacttgaccttgaattaactttttgatgtactgctggattcagtttgctagtatttttgttgaggatttttacgtttaagtttgtcagggatattgactgatattttcttttttcattgtgtctctgctggattttactatcagaatgatgcagactacattgagtgagttaggaaggaacccttctcctcaatgttttgggaatagcttcagtaggattggtaccagttcttctttgtacaactggctgaattctgttgtgaatccatccagtccaggggttatttttggttggcaggttttaaaaaattattattactaactcatttccagaactcattattagtctgttcaggttttcaatttcttcttggttgaatatatagaggttattttcttccaggaatttattcgttttctccaggttttctaatttttatgaatagtggtgttcctagtattctcttagggtcttttgtatttctatgggatcaattgtaatgtctcctttgtcatttctgattgtgcttatttggaacttctctcttattttcttcattaacctacttagtggtgtatcaatcttgtttattcttcctgaaagacaacttttggttttattgatcctctgtatggattttcaagtctcaattttgttcagttcttttctgattttgtttatttattttcttctgctagcttttggctttgtttgttcttctttttctagtccttctaattgtgatgctagaatgctcacttgagatctttctaatttcttgatataagtatttagcagtataaactttcctattaacacctttagctgcaaaccaaagactctggaattttgtctttctgttttcattaatttttgctctactttgttgtttacccaaaagtcattgaggagcaagttgtttaatttccgtgtaactgtgtggttttgagagatctccttggtaatgatttccatttttattacactgtggtccaagattatgcttggtatgattttggtatttttgaatttattgcaatttgctttatggcttcaatttctcaataattttgagattaatatcatgtactatacagaaggtaacatcatcacagattcaggaggaaagaaacgctttctgttgaagttttgatatcatgtctgaaatgagaaggaaacagcttgctcccttggatccgtggttcctcctgttgcctctagagggcgatgttgcatcaagtaggcatctgttttcatcgcagaccatcctcatccattgagcctcctccctgtagctggctgatgtagctcgttgatgtctgtgtggatagggagctgtgacgagagcaagaggtcagaacacatccaggctccttaagggaaagcctctttctgtttctgaaacttttcaaagccagggacttgtccaatccaacctcctcacagttcctagctcctgaggctcagcgcccttggcttctgtccgcccagcttaaggtcctgcagcattgccactgctcagccatgctcctgctgctcgtcccagcgttccaggtgatttttaccctgggtgagtaacattccattctttttccttccacagaagtgactgtgttgtaactgaatctaaattgagacacattttttactcaaacagcattgatgttgcaggaggaaccagagcccagtctgtgacccagcttgacagccaagtccctgtctttgaagaagcccctgtggagctgaggtgcaactactcatcgtctgtttcagtgtatctcttctggtatgtgcaataccccaaccaaggactccagcttctcctgaagtatttatcaggatccaccctggttgaaagcatcaacggttttgaggctgaatttaacaagagtcaaacttccttccacttgaggaaaccctcagtccatataagcgacacggctgagtacttctgtgctgtgagtgacacagtgcctgagactgcaggagagctgaacacaaacctcctgagatgctgagactttctgtgactcaagaactcaacctgtggagctttcaagagggtcccttttttctgtgcccgttttgaaggcacatagggcagggtgggctgagcccttggtagggtttgtctccggaataattgctccaatgtcaatgtcatgccacattcagatatgctttgtcccacatggaggtttcctgatgaatttcttcagtggggacctcctccacactctgaagaaagcacatcataaggtgtcagaactccgaaataaaaggcaacaacatttttatacaaaattatttctagcaaccattatgattagtattgcctcaggtgttaacttgtgaataaccgatgtaattgattagaatgttagctaaaagctgtgcaggatggattctcaattagggtaacccatacagcacagattctcaatcagtgtgctgtagattctcaacctagatttgaagcttaacttctagcacatacataatatcccactgtgtggtattgacatatttaaagtaaattagacataatatcaagatttttaatcttgtgagcattatgcaaaacaggaaattaaacataaatcttaatacaatattgaaaaactaagctgtcaagttgtgatcttttttaaaacagctattccagtgatttccaagttacaaacttgagggataaaaatgtaaccaatataaagatatcaaataccctagattcaactactttaaaaactactttaaaactccgaggcattttattttaagagattacacagatttattatataaaattacacaacaaaaaattccagttgcattatcagagagtatatgaattctaatgggcatatccaagaccagggtaccctattacttactctgaaataattatatcgaaaaaccaacatgttaagatattttatgtacatgattattactccaaatttttatttgtagtttgatcacatggtagaattaaaaaatgcctctcaaagtattataaaatgttcacacatacagaagttgtcttccttaattcaacattttgtaatttttgatgacaaaaattatgaaatgaatcatctcacttcttaaaaatatttacaattgcctaaatctcctcttttaaaatgagatgaagttgtattcttcccttattataaaacatgtgtttaaagtagtttaaaaatattcctatgaattgagctaaaagagggtagagggtttataataaaaaatatttagacttggcttcttctcttgcaccaaagactcaggttcttgcttatggtttctttggctgctgacattctttagttacttcttagcgtgccacctcttccagttttactttcgtcctcatttcattttcgtttgtagtttttcttacagatttgtcttttcattgtgccttttatggcctgttattttgattatgttcagattttacaggccaagaacacttaacatgatgtctattttaacaaatttttgaagtgtacaactcagttaactattggcccaatgttgaatagcagatctctagtaattcttcatcttatctgatagaaactttgtaccccttcatcaacacctccccacttcttcttcccccagccccaagaatggtaaccaccattctactctctacttctattagtttgacagttttagatatctcatgcaggccttctatgactggcttatttcacttagcataatgtccttagggttcatccatgtttttgcatgtggcagaatctccttttttaaaggttgaagaatattccattttatgcatatatcacattttcttcattcatccatcagtagatatttaggttgttcccatatcttggctaatgtgaataatgcggcagtgaccatgggagagaaaatgtttcttcaatatcctgaatttaatttttttgataaataaccagtagtgggattgctgaatcatatggtacatttttaattccagggggaaactccttactgtttttcataattgctgcaccattttgcagcaagggttccaacttctccacattcttatcaacattgttgttgttgttttataatagccaacctaaaaggtgagaggtaataactcattgcgatatctaatttatctggtgattaatgatgttgagcagattttcatataacttcagccatttgtatgtcttctctggagaaatatctactcaaatcctttgccaatgttttaatcaagttattaaaacattgatagttataggagttccctatatattttgaagattagccccttatcagacatatagtttgcaaatatttctttcactctacatgttggctttttttcctattgattattttctttgatgggcagaatcttttaaattttataaagtcctgcttatctacgtttggttttgttgccagtgcctgtggtgtcacatacaagaattggctgttgcttagaccacatgtcatggagagtttcccatatatttttccaatagttttacagttttgggttttacgtttttaattaatattgagttgatttatgtgtattatgttagctagaagtccaatttcattcttttgcaagtggatattcagtttccacagcacaatttgttgaagaactactctttccccattatgtatccttgatgcccttgtcaaacatcagctgagtgcgtatgtgtgggtctatttttcagctctctattctgttccattggttcgtatgtttgtctttatgatagaactatgatgttttaattactgtagctttgtaatatattctgaaaccaagaagtggggtgcttttagctttgtttttctttctcaggattgtttgagctattctgggccttttgtgtttccagagaaattttagaattaaaattttagttttttctatttccataaaaatttcattgggattttgatagggatagcattgtagattgctttgggttgtataaacaccttaacaatattaaatcttccaattcatgaacatagactatctttcatttatttgtgccttctttaatttttcttatgaatgttttgttgttttctgtgtacaagcctttagactaattagttaagtttacttctaaacattttaatcttttgtagctataataaatggattgttttctggattttttttcagatagtttattgttaatgtgtagaaatggcactgatgggcctggtgtggtggcttatgcctgtaatcccagcactttgggaggccaaggcaggcgaatcacgagatcaggagttcgagaccagcctggccaacatggtgaaaccctgtctctactaaaatgtaaaaaattagctgggcatggtggcaggaacctataatcccagctactcggggggctgaggcaggagaatcacttaaactcgggaagcggaggttgcagtgagccgagattgcgccactgctttccagcccaggcgacagtgtgagactctgtctcaaaaaaaaaaaaaaaagaaacggcactaatttttgtgtgttgatttttataccctacaactttactggattcatttattatttctaataggcttttttggtggcgtcttcagggtttttaatgaatttatgtcatctacgaacagaaataattttacttcttttctgatttgagtacttttaatttctttttcctgtctatttactctggctaggatttctagtattatcctgaatggaagtggtgagggtggttacccttatcttgttctgatcttagaggaaaagcttttttgtgtttcacacaccactgagtgtgatgttagctgtgggctttttatatatggcctttattatgttgggggtaatttcccaatttgttgaatatttttatcataaaatgtgaagcaggttcactgtgtactggttaccaagttgtctgagtccagtgagacagaatacacatgcatacaacaaggtacatgaaacaggtttattgattacagataagcaagggacaacagaagcttaggtttcattgcaaacaggtcccccagggctcaggaaagctgtctagggtggatagggtgtcatctgcatgtggcccagttgtaccacacctgagggaccccagaaattagcatgccctaggttttagacccctgggtaatatgataccctgggccaaaaagtactgaaggacactgtttctagggggtatctgaaatacagccagcctgttccagccatttcattcctgtctgaagatgttacattcccagtacattctatagttattcttatttatttatttatttatttttgagacagagtctcgctctgtcgtccaggctggagtgcagtggcgcgatctcggctcactgcaagctccgcctcccgggttcacaccattctcctgcctcagcctccccagtagctgggactacaggcgcccgccaccacacccggctaattttttttgtattttctagtggagacgggacttcaccgtgttagccaggatggtctggatctcctgacctcgtgatccacccgcctcggcctcccaaagtgctggaattacaggcatgagccaccgcgcccagcccattctacagttattcttgagaaccacaaacaagaaagtggagagaactgggttggtccaagaccacccagagaaccatcctgcatgaaaggatgttgaatgttgtcagattctttttctgcatctattgagatgatcatgtaatttttatccctcattgtgttatgtagtgtgtcacattcattcatttttatatgttaaaacatccttgcatcccagggataacttccacttggttattgtatgtgatcctattagtgagctattgaatttggtttgctagtatttcactgaggatttttgcatctatgttcatcgggaatattggtctgtataccttcttgtagtgtctttgtctggctttgatatcagggtaataatggcttcataaaataagtttagaggtattcccctttgaattttttggaagaatttaagaaggattagagttaattcttctttaaatggttgatagaactcactaatgaagctgtcaggtcttttgtcttctttgttaggaggttttggattactgaatcaatttccttaccagttataaatctgtttagatttttttatttcttcatgattcagtcttggtaggttatatgtttgtataaatttatgcatttcttctaggttttccaatttgttggtgtataattgtttgtaatagtctcttaagattcttcttatttctgtggcatccattgtaatgtcttctcttacatttttggtttatttgaatcttctctcttctttttcagtctaattaaaagattgtcaatttagcttatgttttcaaaacttagttttgcttatttttatgttattttctactctatgttttatttatttctgctctaatatttattatttccttctttctactaaatttggacttcacttgttctttttttctagttctttgagatgtaaagttatgttttttgtttgagatcttccttttgaattcaggtatttatttctataaacttccctattagtacagcttttgctcactctataaattttgatatgttgtgtttttgtgtttgtatctcaaaacattttctaatgtgccttttgatttctttgaccaatttgttgctcaagaatatgatgtttaatttccatatattttggaattttctagttttgcatctgctatttatttctagtgttattccattctcattagaaaaaatacgtggtatgatttcactttcttaaatttgttgagacttgttttgcggctgggcatggtggctcccacctgtaatctcagcactttaggaggctgaggtgggaatgcttgaggccaagagtttgagaccagtctgggtaacagtgagactccttctacacaaaaaatagaaatattgacctagtggggtagtgtgcagatacctgtagtctcagctactcaggaggctgagatgggatgatcacttgagtccaggagtttgaggctgcagtgagtcatgatgctgtcattgcactccagcttggacaacacagtgacatcctgcctcaaaaaatgaaacaacgaaaactgccctctttgttttcagtgaccctatgcatcgggaatacactgggtcctatcagtgctccttgacaggtgtgatggaagccagtctctcaggcagcctgtggcaaagctagaatgttggatgtaatgtccaagtctttccctccccagggagaggctgaaactggggctttcctcttatttatgggacacagtacagggggtaggaaaatgtcagaaaccctcctgtcatctttgatgtggttggttgcttgctcattcaaggtactggagactctgaactagttactggatttttcacaagtgaattgatttatttattgctattgaattggtgtgtccatcggggaaaagagggtccagggatttcttttttgccatctttctgatgttacacctttcacggacagaattcttcctgttctcatgggcttctttatttgcccttcaccagaactgacctcctcttgggcatctagttgaatgtggttttcactgtgggcatggtggtcctgcctgagtgccagcaggccaccctgcaatgagagctccatcatacactttaaactttccttgatatttcttttagctgtgcctcttaagcagtagaaggctggatatgaaaaccattcagataatttctatatcttaatagaaaaatttagccttttaaacttatatatgcatgcatttatggctacaactaatatttttgagttatcttacatggcatagtgacatttgacattgtagaacacttccttcctggaatgctttctttattggtttttagaaatcccactcttttttccctctgcttcagtattgtcagttgttccttctcagtcttttttgctgttttttccccacatttaactaatctttaaacattggcaagccttagaaatttatccttgaaaatctttttcctctataaatactttattcacagctggttttattcagtctcttggctttaaatcccatttaaatatccaaacttataactgaatcccagataactcatctggattctggatttgagtatcaaataatctatttgacatcttctttttgacatcctccacttaatatatctgaaaatagtctactgaatttgacctctatactcactaagccttccttacatcccactcgcttcttgtgaacatttcttcattttggtaaaagacaactccatttaccaaatcttctaatccccttagccaaaaactttgaaatcatcattgtcttatcacttttctcacatccccacttgatccactaggaattcctatcagccatttcttcaaaatatccccataatcaaccagttctcatgacctttactgctaccactctgatccaagccacagtaatctcttgcctagttgattgaaagaaacctaactgaacttctttcttttgccattgttcctcttctgtctgttctccatgcagcaggagaagcaatctctttaaaacataattcagataatttcatttctgtgctcacaactatgaaatgtcttaccatctcactcaaaggaaaaccaaatgctttactataatatacaagtccatttagctccctgccatatctttgacatttgacatcagctaccaccttcctacttactcccactctccagcctcaatgcacttattgttgctctaacataccaattattttcctgcctcaaggtctttgcagctgctcatttctctgccttgtgtactagtactccaggtaaccacatggcttatttctacactttattccaccaaatagccatgcacaaaatatttactgcagattatttttgtaatagtgaaaattaaaacacaagatgtttctcagagaatggctacagaaactgtaataaatctttactatggaatattaggaagcaaacatgttaacatcaataggttatcaggacatataattgggtaccaaacacattgcaaactgctgtgtgcttgaaagttatagtcagacaaaaatttaaactgtataaatattgagtatgtattcatccacgtgttctgcaataattttaaattaataataaaaaaataggctccaatttctttctacatctttgtagaaataggctccaactccaatttctttctacatctttgtccatttgctcttctttcattttcatttagtaagggcctctattcaactcacaagcttatttagcttcttgattgcattctgttttatcttttctaggaacagacaacaatgatcatattcttaaatctttgtctaaccatcctttgttttaagaaatggctccttatttctgggttcattttgtactttttgaggtgttacttgatatatatgaaaacacacacatgtgcatgtttgtctttcccactaaactgcaatgtcttgtgagtagagaaaatgtcttactaattttttaatttcgtaagacctagcacaagatctagcttacagtagacctcaataaattactaaagacttactttgaaataaattggagaaatcacattaaaccttgaggaagcaatttgataaaatattttaatatggtaatctcttgtacatggaatttggaggaagaaaccagtttcctttttttaaaaaaaaaaaatcaccataagcctgacagtttttttgctcttgacaatctgggtggttcctcaggaaagaattgggatgaaggctctgggactccacagatgagttagtgggcctgatggtttcagaccactaggaggctctctaggctttactctaaatgaggaaattttccctcaagttctgagatagctgactcagcgaaaaactgagagttagcatcagttagcaaagcatctgaactagtcatatatgaaacggacagggggagtctccatttattcatctgcaaagatgttctgtggctgtgatgggtgtcacagagacggtctcccaagaagactgatcttagaaatcaacaagggaaatgataaagctggaagccttacagctttaatttttatgactaaaacttctaaaatatgagtctccattctgactttgaaattatttcaataatttccaccttcttttatacctcctttgaaactagaaaaacaagaaaaaggaaatgagaagaaatgagaaaaaaataatgaaaatattcagagagaggataaaagagagtaaaagaaataagaggttgggggaaaaaaagatgacacatttaactgaatttcaaaatgtggtctatgcctcatatagtttctgtgttgcaaggttaaaaagttctagagatctgatgcacgacaatgtgaagatacttaccactactgaattgtacatgttaaaatagtcaagatggtaaatttaatgttatgtgtttttttaccacaataaaaaatgtgacctctacctcttgttcacagagcagaattgaccaggtggggctgcaaagtgaatggagaagtgttggatagaagaagagagatggaaataagctggggtggccatcatatacacgtgctatttctctatcaaccaaagtctcactggagacattttatatgttcatgatgactatatgtcctatgttaacagaattctcttaatttaattgtattgtatttactcctttaagggtgattaaataaacgatgcattcgatgagatattctttctttgtgagagctttcttataaataaaatcacaatcacttttcaaatcacatgtcctgattttttggctaaggaaattgggccactgaccctgataattttttcaggctgtacttgatccagatgaggctcccatttgtctctgagatatcttttccctttcttcactcccctcctgacttgtccgattactgggtactttaagtggaggcaatcctgagagcataaaaacctagacatttctgtgtctctagtcagcagtgcggcactcagcagggtactgacgtcagcaattacgcccgtacactgcaggaaaactagaggaaaatctctttgctccctgatctcattgtattccacctcatttaagtaacagcatatctcttacttttttctcagctatttggaggccagaggagagactttctcaagagaattagttttcttttttagaaaaaaatatatctgccggagacgctatctccatgacccatagttttctgctcttaatcccggagcttctgtctacttgaccccagatttatatctgaccccaaaatgggacacctcacttgagctctctcaacacagcttgactgggagctggagaaaatctttggttaaggaccagggattggggactctttcaatctaccatttttctagaatttccgtctttctgagccaaatgattgttcctttttttatggccttcttttcttttcttttttctttttttttttttaaagtgtatagaactaaaatcccaaagggccatttcctgtgtggggaaggtcagaatcaatgatggtggacggaaaataaaataacttgatctggcaatgtttaaacatttcactaaaatatctgtgtagaaatttaaatttctatgaagtgtaatcgatcaatattttttcttatgttttttgactgttatgcttagaaaatccatcaccattctaaatttattttaaaaattttttattttacttaaaatattaaatgttacgtcctttgaactttatttgataacaggtattaaggtaggcatcctaacttatctgttaacttccaaatgattgttaggattgcacattttcccccattttaactaagtttccaaatgtatttgtatatttgaactttgtattctacttcattaagccctatatgtggattttaaaaataacattctattgcaattagtatagcatcacacttttactgaggaggaaattctcattctctgaatttgaaggcttcctgaagcctgagttagctgcagtattgtatttggcctctagagagagatgttacacaaattgaatttgatagccaaaaacaacctgatctttttgaagaatagcttttggctatacatgccgggtaaactcatccacctctctgtcagagtgtctatgtggctgaatcgtttccagaaaagacctccagaaaatagcttcctgtttctccacaggtcagacatgaagcccaccctcatctcagtgcttgtgataatatttatactcagtaagtaaagcctctttttgttctatttttctatggtattctgatttagaataactttaatgaatattatccccagtctgtaagacttttcctgatccagaattggtgttataggaggaacaagagcccagagagtgactcagcccgagaagctcctctctgtctttaaaggggccccagtggagctgaagtgcaactattcctattctgggagtcctgaactcttctggtatgtccagtactccagacaacgcctccagttactcttgagacacatctctagagagagcatcaaaggcttcactgctgaccttaacaaaggcgagacatctttccacctgaagaaaccatttgctcaagaggaagactcagccatgtattactgtgctctaagtggcacagtagctggttttgcaaggaagcagaacacaaaccctttaaatacaggaaatatttctttgcaaactctctgtatggccacagcagggcattctttctccagaaattaatattgagtttatctcgtagatattatatcatcagtcatcagttagctatagattaacctcataattttgtccaaaaaattctcattatttaccctgcttaaattaaatttaaaaatagtaaatgtatttattttgtctagtagtactggaaacatactttcgaaataaaaactatattgcactgcataaaaagtattcttttctttgttcagaggtactgtccaggcttccatggtgcagtcctacctcttcaactcctctgctgccccacgtgatccccacatgtggttgtcaccacatacctgagcatagttcctcaaagtgctctgctgtttcatggcttatgattgttcatctttctatatctattacccttctttccatgagtttcatagactcctcctatctcaattggtgtccagccaggaaaaaagaagcccagtgaagtttaatataaagatttattaaataataataagtaattaactactaatgggtaaaaaaacctctaaggaatataggaatgcacatgtaagcagaagttcctgtctctaggactaaggtagaatcccaggaaaggaacagattggcataagcatgacccctcctgccaaggctatgattcagatctcattgagagtgtgtagctggagcttgctgcatagtggagtagtttgctgaggtgccagagaaaaatactgacaagcagaaaaatacctaccaggattacaacacaattcatgggaagcccgcaaacgagtgctgctgaacttgcttgtggtggctgtgaaacttgccaagaaaccacctgtcgggcttgctggaggggagtgccactggtgtcctacaggccaacgaagcatagtggacaagaagtgtggaaaacataccagaaccaggaagagaagcgtcatccttctgcggggtccttccagccccctctactgacaaagcttaatatcaaatatttagagggtccagatccagttcacaaatagggtaattagggtggatttggagctgagaggtaatacattgataactgtcacaccctatcccttgggctactgatctttcatatgcattcctttttttctttcttctttctttttttgagacggagtctcattctgtcacccaggctggagtgcagtggcgcaatctccgctcactgcaatctctacctcccaggttcaagtgatttttctgcctcagcctctcgagtagctaggactacaggtgcctgccaccatgcctggctaatttttatatttttagtggagacggagtttcaccattttggccaggctggccttgaactcctgacctcaggtgatccacccgcttcagcctcccgaagtgctggtattacaggcatgagccactgcacctggtccatatgcattcctatatgcacatttcaacttccaaacaatagtgaaatgacactatgttgctacctaataagctgaagctgtccttgaacaagtggagttttcattctttctcccaaatgagatgatccatagtcccaacaaccactgtatgaatccctgactgtatcagccacatctcaagttcagaggaagttctactgaatatgctgttatatacagactaaattataaagctaatctccaataatttacatataaaataattatgataagaaagagagaataaaatggcagcatatacaaagaaacacttacatataatgagcaaagataaaatacagaaagctaccacattccttgattccagacttggtcctgggcttcaattgacatagacagcttccttctcttgttacgtattttatattcttctgccctcatccacgtcatcggtggattggagttatttacctggtggaatgacaaaaatcttcattctcgaagagtctgagttctcaatagtcatggcttttaatttgttgctgcaggtttcccttaacttttactattgggcacgaaagtgccattaggctcctcaaaaaaatcccccgggttttagatgtagctctctctacatgtgttgtatggcttctggagctactcgcccccttcctaacaactttgcaacatgttctggtaaccatcacggtatattaaaactttatcgtatctcctcttcctgttgagctgaatgttccagagaagggccgttatgttctctctggctttaatctaaccttctaacacagtatggagcacacaatatgtacacagtgaaggaatgttaaataaattcatttaaacaaatagaaaaatcagcaatcctctcctgtgagcatgtgagtcaacctccactaatgtgatttcactggtttcttcagggaaccgtgtcaaaccaattaatacaggcaaacaatatgttcatctgggcaaacagatgcctaatcaggttaagagttttcttaattggaaaaatagcttgcttatgaagacaatagttttatcaataaaactcacctcaagaccttcggcacatcattgtaccaatcctaaactcgtatatcatgaactagagaaaatagctgagaactagagctagatagtgagttcttggacatgcacacaaaaagtgcagtctataaaagaaaaaaacgataaattagccttaaataaaattaaaacctttggcattgtagaaagaccttgttaatagaataaaaggcaacctatagacagagagaaaatgtttataaatcacacatcagacagaagtcttatatctacgatgaataaagagcacgcaaatctcaatgtaaaaaagaaacaaataaataatccaattagaaatagaatagatatttcaccaaagtagaaatatgggtgaaaaataagcaaataaaaagatattcaatatcattcttcactagcaaaatgaaaataaaaatcacaatgagatatcactataaacatattagaacagctaaaatacaaaacagtaataatactaaatgttggtgagtatgtagagaaatggacacttttatacattgctggtgggattgtaaaatagtacagccattctggaaaataatctggcagtttttttataaaactaagcatgcacttatcatatgatcacaccattgtgcattggacatctatcccagtaacattcacataaagtcttatacaacattcatagtagctttattcataattgccaaaaactggaatcaacctagatatttttcaacgggtaaatggttaaataaactatcatagttcataccatggaataatatgaaaaaaaaagaacaaactgttgatacatggaacaacctgtatgggtcaattcccaaaggttacatacagtttgattccatatatataacattctcaaaataacagaactataagagatggttgctaggggacagagattgggcatgggagggtgtttgtgcatatagagggttaggatgagagaattctatgttgatggaacagtctgaatcttgattatgttggtggttatatgagataaaatcaagaaccacacacaagtatgcatgcacacacgtggagaaaagcaagaaaatagtgacaattgaatactacctgtagtctagttagtggtatttgaacaatgtcaatttcctggtatttatattgaatttcagttatatacgatgtcaccactggaagaggctatgtgaagagtacatagggttctataaactattttggcaacttgccatggatttataataatttcaaaacaaatacagtactatagtttcaaaaattgcattctttactctcaccaccaattttatcagtaaaaccgctaagagttgggaaggtgtgaagccgatggtagtggatgcaaattttccaaaattctaattttcacttggaagctcaaatattatcatgggtgacaaccactattagttgttttcctcaaaatggcaggctcacattttatcattttcaagaacataccttccaactacccaaatctgctgttctgtcactcatgccttcaagtaaaaaaaaaaaaaaaaaaaaaaagttctatgagaaacagctagtttagctcacaactcaaacaatactccagtgtctttctctcttgaggcaccaccgtgttagtacaccacagatgaactttatgcatacgtcctatgtcatcacacagaatatttaaacggtgtactctcaagggtcaagatttaatttaaaaaattttgcttctacatctaggacattgttgagtaaaatctttttctcttgccagtgtggtggtaatgattatgtacaatgactactagaatattttgggttcatttattttacctgtgttaaaacatcagcaattgcatttgcttcatcagtgtaaatgtcaacacagtgaaagactcaagtaatatcagcactattataaaaatagttttattctacctcacagttttaactctatctcacagttttcccaagaggtcagcaatatttctggttactttttgcagatacagctaaatacatacaaatattaaaagtactatattcttgacctcctcattgtgagacattagacacatcatttaatttctttgaaccagggtacatcttttaactactattctaaatttgctcacagactgtttcaaaattatctggaagagagcagacagattaaaatttcagtttgttaaataacactggttctttgctcaaaaagctttcatatgtctttatttcgcactgaaaaacataaagatttattttggcagtcatctgacccagacccttcctctagacttatgtcttggaaccctccaatctacatattgctctagccagcaatctcttcttctcatttctttttttcctttctctgttctcctgtcttctcatctttcccatctctctctctgttttacacacaaaataccttaaaatcaatttttgggaacatttataaaatactctagaagattcttgctattctttttgactgctctgcatcaggacccattttcttataacaataataatttttcagtcactaatgaatgtcaggcactgtgctaaatgacattttatgatctcatcgttaaccttcaacagctctgaaaaggtagtattattatttactcatgatccatgttctacagccaagataatgtaggcacagaagacagaaacagctactgaactgatagatgtaaacctgacttcgatggcctgactataaaacttcctctcttcctggacccgcctgcctcctgccatagaaactaaaacttctaggtattcactgctatgggctgaactgtgtttccacaaaatgtggacgtagaagcgctaacccccagtacctcagaacatgactctatttggagacagaacttttaaaggtaaagttaaaaggtggtcttgagggtaaccactaatttaataagactggcatccttaagaggagattgggacagatagcacaggcaaagggatgaccatgtgaagacacaacaagaaggcaaccatttatgagtcatggagaaaggcctcaaaagaaactaaacctgccagcactttgaccttgaaattgtagtccctaaaatcatgagaaaataaatgtttgttgtttaagccatgcagtctgtgatactttgttatgggagccctggtaaactaatacagcctactggttaggcttgatgtgggcacatggcttgggctccaacaattagatgaattgttccctaactttcactcaggagttacttttgcaaaaaaacaaaaacaaaaaacaaacaaaaaatgagtaagagtttcctttttgagagtggtggtaattgcaacaaggtggacatgagagtttacaggctacaaggcagtggaattgtagctgcatacattgtcctgcgtgaacagtcttgcataaactacgggcagtatctggagctcaggaaaggagccagtgggatactcagaggagtgcttctccagagtgattttctgtactgctgctgacttcatagcttttgagttcagttctctgaccctactggagattctgaggtaaatccagtattcattaatttattccttttctacttaatttaggcagagtccatttctgttgcccatcagtaaaaaccttgacttgtatataatctcattccagggaaaattttttaaaaggaagctcgtaggtacatgatcagaggtcatagtaactacagggaatttaacagtgcttctcagaggtagtctgaaaatattgagcaccaactgtctttcgtagttgagttcttacctgaattgaaatgtatctgttcctattctaagttagaattagatttcaataaaggcagagactggaatagctttgtaatttcttctgagtcagctctgaacacacgtcctgatggcagcaggatgatgttacgatcacaagagggcagtgcctccctctcctcagactaacttggctttaaatcagcctatctgcattgaaaggaaaggactgagcttgcctgtgactggctagggaggaacctgagactaggggacagaaagactagggattcacccagtaaagagagctcatctgtgactgaggagccttgctccatttcaggtcttctgtgatttcaataaggaagaagaatggaaactctcctgggagtgtctttggtgattctatggcttcaactggctagtgagttggggattttggtgatgggaatggcaagaccaaattttagagcccacagggctgaggggtgaagtgttcttattaatttggaaatgtaatttgaaaatgtaatgactgactcctggtcccggacctgtgtttctgcctaggggtgaacagtcaacagggagaagaggatcctcaggccttgagcatccaggagggtgaaaatgccaccatgaactgcagttacaaaactagtataaacaatttacagtggtatagacaaaattcaggtagaggccttgtccacctaattttaatacgttcaaatgaaagagagaaacacagtggaagattaagagtcacgcttgacacttccaagaaaagcagttccttgttgatcacggcttcccgggcagcagacactgcttcttacttctgtgctacggacgcacagtgttccccaggaacctgcagcctctacgcaaaccctgccaaagcagcttcttagaagccctaatagtgggtagaattagtggttatgtctttcagtcaagaagagtctacaaacagctggcaaagtaaaaggggaactctttcaaattcgtgattttttaaaaagcatcttggactaggggaaaaggcatgaaatttggaacaggaaatggaaatgccaggctcagttctgctaatcctggctacatagggacattgtcagtgtagcagccttcaatttcctcacttgaaataaaggatatggatcaatgagcccaaaatattacttaatccctaattttattagggaaaaaaatcactgggcacttgtggaagaggaggaaggctgcacagttttagaaggtctcatttgtcctatgtgcagccctcccaagacatcagtgggtctttaaggtgcatgaggtggctcttaggttcctctaattcttgtataagaagcagtagattcattaagcattagaattggaagaggtcctaggactctcaaccaagcttttcattttagagctgaggagtaaaaccattgcataataagacagacaattttctgaatctttggagtgatagtgacaaatatctggatctgatttcaccatttattagttgtatgattcccaagcttcaatgtctctattaggcaaaatgggaatttataagaaagtaacaacttttccccatccaaaggagagataggtgtttgacactaccaggtcctaaaacgctgtgttttgaaagcaggcatttttagtaccaaatacataacagtttttcagctatttattcttgctcctactgagaaataaatactgactatagttttcttgacacagtttagatactactgaaaatgtgtttgtggagaaaattagagcatttgtatttaggttcatgctttggtgagaaaagtgggggagggcagggaaaggttgtgtcagaccttgacccattaatattagctgtaccagaatcactagagtatctttgaagatctggactattaagctcaattctggcttactcaatcagcctctgataaagtgatgaatttcaattgtaatgaatatcttctatatatgtaagagattggctcaggttcacatttaaaaaacccaaacaataatgtttgtaacaagattgacgagtttttttccacataaaggagctctgtaatattcagggctggtgctgtagcttcatcatgttacaaaggaactagggtctttctagcttactgtttttcactcttaatgtgtcactcttttttttacactttcaagagactgatagagatccttccactttatacaccttccagactgaaagaaggagaaagtcaagggcacatgtacatgctggctgagtcagtcttttccagaagctccgcccaatggcttctgcttacactcatttgctagagtggtattcgatgtttccacctcctcctatctgcaagggaggctagaatatcaggattattatctaagtatatttctattcacagcaaaatttgggttctattagtaaaaaaaataggtgatgatggacattttacagacaattagaagtttctgccagaccctcagtttaggacatattaggactcataatatttttggttcatagttatttttgaattaccatatccaatgtattttcaagttctattgagtgtaccacctactaagttttccagaagacattacaacctctataacctaattcacctccacacccaaatttaaaattctccctaatcgcttactcctctgcccccagcaagcttgacagaccccatcacttctcagtatagtgctttgtacacagtgagggtgaccttttcagagtgcaaatttgaccatgtcaaccacctgggtcctcactggttcttagagtagaaaaaaaattgcttcatgtgatttacaaaaccctccatgatttagactcttaatacctctccagtatctttccacaataagctcctaatttatctttttcttcaatactggtcctatctacgtttcttgaatgcactttgtttatcttatataaccccctcaaagcaattttaggatacattcttactctttttaaaaaattattttctcttcccttgagagtagagcccagtaaatgcctacttgttctcatacgtctgttcaagagtcagtaatagaagaaagctcaatacgctttcttagaattgtggaccactgcctttttaaatgggcagtttctccttttatttctttatttaattaataattgtctctattattactctatgtgctccttaagggcagggaccattatctgtgctgctcagccttgaatctgtaacaccaaagtaacttaagcactaagataatcaatttttcctcttctttcttcctattaatttatttaatataatatctttattttaagcctcctctaagagttaaaataatgttgtagtaaaagaacacacaagaggtcgggcgcaatggctcacgcctgtaatcccagcactttgggaggccgaggagggcggatcacgaggtcaggagatcgagaccaccctggctaacattgtgaaaccccgtctctactaaaaataaaaaaaaattggcagggcatggtggcgggcacctgtagtcccagctattcgggaggctgagtcaggagaatggcgtgaacccgggaggcagagcttgcagtgagccgagatcgcgccactgcactccagcctgggtgacagagcgagactccgtctcaaaaaaaaaaaaaaaaaaagaaagaacacacaagacaatagggctgagtttttcaaactatagtccatgggtatttggaattgtatgaataaattgttggtgtataatgggggtcagaaaactatggcctagtgttcaaaacaacctgccacctatttttgtaaagttttattgcaaaatagccatgctcatctatttacacattgcttatgatggcttccatgctataacagcagagtttagtacttgcaacagagagtgtatgatttcaaatatatactatttgtccttttatagagaaaagtttaccaatccctgaggtatagaaattaaatgagaattattagatctgtgtgcttaggacaatgtaaaataatgaaggtacatttctaataatctagatgactaatagaataatccccttgaatttgatttttttgtcacttttaccaaattaagggtaaatgggataataatactctacaaatgaagacattgcagctgtttaaatggtgaaaagtttttggaaaattttggttatgatatagaacatagcacatagcactacagatgtatcacatagtactacagatagggcacactcccaagagcctgcatctttccattgaaagaggatgtgttgcaaaccttcattgtttgtatgcatcaacgtgcaattcaatagacataaaagtagcagtaaataaaaaacatttttttcagtgctgaattcttgggtgtttcattaaataataaaattgtataatggtgactgacatgagtatttctaaataggaaaagtgaagaaaaaatcctagtaatcactaatcacaataactcagacaatagcacatcaagctccaaataactttaatcaaatcagttattcaactgtacacatccatagctttcttttaataagtctacactaaccgttgagtttcagtgaaaaatcatttcttacactaatgttttaatttgaattttatcgattttatattttgtttgaagtttttgtctgatttggtaattgtataaaacctgtgagcctaaaaagttgatacccaattttattgttgggtatatgaaacaccgtaatattaaaaaaaatggttagtatgagagtggctccttataagaagacctgcaccttactcaattttgaagaacacggaatgcacctgctaccaggccctggatctactcctaaatgaagccagtcacaccaggggcctaagacactagacacatcttcccacagactgtccttcatcaaagataattttgcccaccagatacagccattcattcattttttccaccaatttttaggggttttttttgagcatttcctatgagctaaggttctaggaaaagggctgctgatagtaataggattcaacttctgatgcaggagcactaagtgcagcttgagaaacaggacagaaatgattctaatatgatgtgataaggacagaaaatatggtgggaaaaaggagagcactaactcagctcgagagatggcagaatgttttcacatggaggtgatgcactggttttcaaagaatgaacaggagtcatccaagtgaaagggagtggggagaaggaagggcattctaagcagaagtgctcaccccccggttttgggggaccagtgggaaatatgtcgagaaaaaaatctcacattttcttttttttatattctcaggatatcctgagatgcctaaaactaaattaacacttgttgtgaacacattagatgcagggaatggggagattcaagggaatcatattgctctgcgccttgaagaaggcgacaggaatcacccacacgatgaagtcagcagagtgtttgatgctccttccttgagtcccacccttcacctcggacaccgttttctttctgagtctgcaggttaagccgcaccccagggtgaaaatgaacatcattctgagactcagagcaggcgtcagggacagagaggagcctcaagagggcgctgctgccttcagcttgtggtttgacacaaatttcatctttccttccttcgcacgtctctttgttccagcctgtggcctgatcttgtagggcagtttactctgcttaatacgtgagtcaagattttgtagaagattccgccaaagactcaacaacataaagaaatatatatacctttcggtttggatatctctcaacaaaaccttctactgcttctcagccagccatgctgtctgcttcctgctcaggacttgtgatcttgttgatattcagtgagtaatgtttactcaaaacttctgagatgttctattccttagctttaggatgacctttaaccccttccaaactggagaccatgcctcttctattgccactataataaagtctttcccttttttaggaaggaccagtggagactcggttacccagacagaaggcccagttaccctccctgagagggcagctctgacattaaactgcacttatcagtccagctattcaacttttctattctggtatgtccagtatctaaacaaagagcctgagctcctcctgaaaagttcagaaaaccaggagacggacagcagaggttttcaggccagtcctatcaagagtgacagttccttccacctggagaagccctcggtgcagctgtcggactctgccgtgtactactgcgctctgagagacagagtgggagggactgcagcgagagcccagcacaaaccctggggaacgcaggtggggcctgggtgtgagccgctttgggagatgaatgaatatggactcttgttcgctgggaccccaaatggagaaaataatctcatatttctctgcatcaaagagcacaaaacagaaatgtgggcccctcacacatgggatgtagctcaccacgagaaacttttcctaatattctggagttctgtgagccttgtttgtcctttgtctctcctgcatgattctgtgagttttacacataaaaatgcaggttttgcagggcctgatgcttctttgatttctggggctctctttaagaaaaagaaaattaaattataaatttaagtttctaggttatgcggtagaaaggggccttaaaatcaaagccgaatatacttcatagtaaatctgcatttgaggttacatagagatgatcttctttaagactgaaatattataatagtcttagtttgtcctgatactgggaggttccctaactccaagtcctctttcccacggcagcactagaatcactttagctatcattaatatgagtattttcacttctatctttaaagaaataacagctttattgagatataatttgcataccttaaacttcattcttttaagtctacaattcagtggttttagtatattcacagttatccaatcattattgtgatctaattccagaacattttcaccacctcataaggaaactctgtgcctactagcactcacccccattcttttcttaccctagccataaatcaaataaaaatattgatttatgaggaataataacacaaaattttgatgtacccagtcttattgtaaatacaggacctcttatgaacctgtatctagagggatgaaacataagtcccaacatttaagactgcaaagagtttaatgactgtgatgcaggggacaaaagccagtggagattgaactctgctggtattttaacaggatttctcttgtttttggtaatgctttggttacaaattatatatttttgggtgtttcccatcctaatctccaccataattaatatgcatggattggaatagcaaggggattttcaagaacacacatattgagttataacagaaactcctgtctttgagcagtgagtagaatttctggaatttatttttgtttacacacacacacaaaatatgtgtgcaaataaacatgtaggtatttttctctggtgttactcgacatggcaaacactgaacagatttggtgactcaggaggtatgttgtgaaatcatttattaacaataaaactatttctttttttattatagtttaagttttacggtacatgtgcacaacgtgcaggtttgttacatatgtatacatgtgccatgttggtgtgctgcacccattaactcatcacttaacattaggtatacctcctaatgctacccctcccccctcctcccacccacaacaggccctggtgtgtgatgttccccttcctgtgtccatgtgttctcattgttcaattcctgcctatgagttagaacatgcggtgtttggttttttgtccttgtgatagtttgctgagaatgatggtttctagcttcatccatgtccctgcaaaggatatgaactcatcattttttatggctgcatagtattccatggtgtatatgtgccacattttcttaatccagtctaccattgttggacatttgggttggttccaagtgtttgctattgtgaatagtgccgcaataaacatatgtgtgcatatgtcttcatagcagcatgttttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgatcgccattctaactggtgtgagatggtatctcactgtggttttgatttgcatttctctgatggccagtgatgatgagcattttttcatgtcttttggctgcataaatgtcttgttttgagaagtgtctgttcatatactttgcccactttttgatggggttttttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatctcatttgtcaattttgtcttttgttgccattgcttttggtgttttagacatgaagtccttgcccatgcctatgtcctgaatggtattgcctaggttttcttctagggagtttatggttttaggtctaacatgtaagtctttaatccatctggaattaattttcgtataaggtgtaaggaagggatccagtttcagctttctacatatggctatccagttttcccagcaccatttattaaatagggaatcctttccccatttcttgtttttgtcaggtttgtcaaagatcagatagttgtagatgtgtggcattatttctgagggctctgttctgttccattgatctatatctctgttttggtaccagtaccatgctgttttggttactgtagccttgtagtatagtttgaagtcaagtaccatgatgcctccagctttattcttttggcttaggattgacttggcaatgcaggctcttttttggtttcatatgaactttaaagtagttttttccaattctgtgaagaaagtcattggtagcttgatggggatggcattgaatctataaattaccttgggcagtatggccattttcacaatattgattcttcctatccatgagcatggaatgttcttccatttgtttgtatcctctttgatttcattgagcagtggtttgtagttctccttgaagaggtccttcacgtcccttgtaagttgggttcctaggtattttattctctttgaagctgttgtgaatgggagttcgctcacaatttggctctctgtctgttattggtgtataagaatgcttgtgatttttgcacactgattttgtatcctgagactttgctgaaattgcctatcagcttaaggagattttgggctgagacgatggggttttctagatgtacaatcatgtcatctgcaaacagggacaatttgacttgcgtaataagagctatctatgacaaacccacagccagtatcatactgaatgggcaaaaactagaagcattccctttgaaaactggcacaagacagggataccctctctcaccacccctattcaacatagtgttggaagttctggccacggcaatcaggcaggagaaggaaataaaccacgactggcaaagtagtaacaaagattgagactaaaagttttgccttcctgctagaaagtgaaaactccgtatggttagtttgtaccttgattctatctggagaaaaagacatatgtaagaccaaaaggtgcataactgtatcatcccatgtattcactatagctcataataaattgtaagtctcacattttccaccaaagatgaattaactaaccgtgattcaattttaccactgtatatttacagtccagtaagttatattgagacaaaattggtacttaggacagtctagcatcttccatctctacaggaagtatgtgacatgacacagtcaaactcatcatatatctgttaactatacttcctgtaaaaggcagaagcctcacacagcccagtaactttgctagtacctcttgagtgcaaggtggagaattaagatctggatttgagacggagcacggaacatttcactcaggggaagagctatgaacatgctgactgccagcctgttgagggcagtcatagcctccatctgtgttggtaagcgtgaccactagcacaggacttaggctcctgttagttcagaaggatgtggagagaggcagatctttttagtctaatgaggcttagaaagaaggggtaaagggcaatgaaatcagagcactaggtctgaagccacttaatctattttatccccagagttacaaataagggatcagtctattttttcctctttttcacagtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgagtgaggccacagtgagatgggtgcctgtgggagccctacaaaaacctcaacaagaggcagggctcctggggagagactctgtcacagacaggaagaagcaaggagggtctgtgtcagcacaggtggtttggcaaggaaacctgagttcaattcatgtacaatgtctagatataacatttattagaagcatgtgtatcttctattctttagaatagattaagacagaatgtatagcacatatttttatatcacatatagaattatgcaacaaaaagtgcaataacaaaatatattaatcttgtgttggttttattgagggtgggaaactatccaattatcttcagaccaaatggatgattccattcataagctgttaagtttttagaatcacttatacatttatgcattaattactatgtagaatgctttaatccaagagtaatagaaatgcctttcatcgatttttcttaagaatggtatcagtactcaatgaggtaaaaaaattaaatttaaacttctttccataatcatgccagcaacctcttgtatatcagaatagatgcgaaatgtttctcaaatttcctttctctggctcctctgtttttgtgacatgattatgatattttaaaagtatctaaatattttgctgtcatttagaggctgcctactaagagagatgtctaaggtggaaatttgtcctaacggattgaatatcttgctttcaccctttcccctttgagttctggccagtttgaagctgagaagtggttagggccagaattacagctgccatggcaaccagaacccacatggtgtgtccagtgtctacttcctgtctaaacacatatttctccttggatgttacaacaggtgctcaggaacaaggatttttatttcttttgctccacacaagtttttagaaacctgagtttttaacattaaaagaaaacagacatcacattaaaaaccagatttctagcttacctataaacatgggaagagctgggaaacactacactccctggggtagaagtcaaaagttctgtttggacacataatggttttgatgtatatgtattttatttttaaaatttatgcaaatttaccattcatttcacagtatgaattaatttaaaagtaaaaatttaaattattagttacaagacaagctaatctgcaagacaaacaaatctgaattaccatttcatgaaactatacctggttttccccccatgatttcatgtatcatgggtgtgtcccagcttgagaaccttaagtatagtttattcttaattcaggagacatttgtagctatagtaagcattggagaaacattagttaataagacagacatggctcctgcctttatggaggtcatgttctagggggctatatccactatagaatggtaggcagagggaactaaagttttacacaaacaacctatgtgaccttaagaaagttataactcccctgaacatgttctctcatttgtaaaatgtagagatttaattaggcagttgctattgaataatattttccaaaattttactagcctcacaagagcacatagtccactgcctttttgagttcctaacacttactagctgcccttcttttttgggaaaggacaattagttgttatagacatattcatactgttccacatgttgcatgataatgtaacagtaataacaagaagccaaaggaagcaggcagagaggagagtggcttgggaggtcatctgctttccatacacagaagctactgttctatgtagccgggcagcagaggaagagggagaggaagaaggcgagagggagggagaggagaaaagaaagaaggatgaggaggagaaggaggaaggggacaggaggaaggcagaatgagggatagagaagagatgaagggaggaagaaagaaggaggaaagcacagaacaggtactaattcgaaagtaaatatgtttatttgaattcgaagtttttgtttctttcacaaggcattagacacactttctttcctcagcatgagagaatgagaaaaattagaagattcctatttgacaagcatgaggtcacactgaacttggactagctggctgaaactccagaggacacagctcctccagttaagctctaaggcaggttgagagacagattttctagtaattctggttgtcccttgtaaaattaatataattcatctgttcctaaaggaactaagaacattgtaactgggaaaggttccttcaatattagagttctctctagagctaagtagcaaatgcaaatgctcataggtgcctagagtagaatgaaatgagtgtggttgtccaagtgtttaaaaaggtacaggcctgataatgtgtcactaggcactgggccttggcatcagatgataaacaaaaatgatgcagtaaaccctcccattcttctcctaagcagagtgggtgtcctgaaaggttatccagagattgaagctgcgttgtttgttcctgagtcctgtcaaagtcaggctacaagctgttagatgtagacaggccattgcacaagagcttttatacaggaagcttctggatgaggggctggggagatgaagccatcacagtctgcaaggcagctgaggcttattccagcctctgtgaataaagtcaatgataatgaccattaggctccagcccctgctatttcctaatgatccttatcagggaacctcttcaggtgttccctgaaattagtcaccctcataccccacatctcagagcctatgatcttgcatacgatggatgtcttcactgcagaattgttccagtatccctgggctaaagtttgactgagttcaaataaagcatatcacacacagagagagctggttaagctaatgagctgtccagggttatgtaatcacttggcttacataacttctggacatgatccattgtcataagcatttttttttaaaagaatgaaagcatatattaggcacatattatgtgtgatacaaagaatctctgaaccttacttcttatccctctttattacatgtagtagttgccttctccatgacccctagtacaacctgcttaccatctacatcctttgtgtgtttgccctcatttccatcttctacgacacaataagacacaagttcaacagctcagtgctgttccaaccccagatggtagcattaggagcctttccacctgatttcataattaaagtttccttttctttggaaaagaggaaatttccccatcagaattggacacccttgggagtgaacagtaaattgtcaaatatgtactctcccagaagtagagtggaattcttgatgtttcccaccatcgttattacacaacctccagtctctttcagaatttccaaacagagggaaaaactaggtggacttgaaatagtaactcaatccaacagatttcccacattagtgaaaaatagctttgttttctgttcactgtattaaacaaaatactgccctctagacccaatcgccaatttatagtaagtacaaaggacagcagaacatattaaacccatcacaaatatacagtaagcaaaatctatagtgtgaaaaactctgcaagacaaacaccctgggtctttttttcttcccacaataaactacaaagaatgagtaaggggatctatggattagaagagcctttaaaaaacatatcgccagaactttggctttcccagtgccccatgcttgcaccatgtagaagtgcaagcagacgaaacctcagcatgccaacttggaggaggaccagggtgagcagcaactgaatccagagttcgcagatgcagcctgaatggcgccagtggtgggggcccagggtgctccaatggatcaccaagggaatgatgatgaagcgaatgaggacaaagccatgtggtaaaatggcttcatcaggaggagatggacacctgtgagaaatactgtgcagagttctttagcgtctctgagttcttgaaacataagaaaaattgcactgaaaatccccctgtcctctccaggaatgacagtgagaggccatgacagctctctggagccagactgagccataccagccacccagtccaagtaataaagatggccacaaggagaacagtggcagctcaggggacatgaaagagaagctgggtgtggagtctgtggtgcacttacagacagagatggccctgccacccacacctaaggacataggctatttacccacacgcaaagtagccaacgctaatgtgcccatgcaggctctctggggcaccaaggtggcagtgaatctgtggagtgcaggtgcactgccagcctgtgcccagtgcccacagcatcccatgggtcctcgagcagatcttgtatctgcaacagcagctacagcagatccagctcaccaagcagatctacattgagatgaacgtgtgggcctcccacatcctccactgtggcagggcaggggctgacaccctgaagactttgggcagccacatgtccctgcaggtttctgcagctgtggttttgcttagccagaaggctggaagccaaggtccgtctctggatgccttgaaacaagccaagatactgcacaccaacatcccttctaccttcagcactctgccccaggactgatgccttttgttctgaagccagatgggaaaagggtactctcttccctttccctgtttgggaaaacatcatgtgtcccatactgagtgctttgctccctcaggctctgggcttggtgctcttccagggtactttctccactatggcattagacccgtccaagaaagggaaaggaaggctatggaacatctccaagcacaagtgtaagtgctctagcaaggtttttgggactgatagcttctcatggatccacctctgctcccacactggagagagacccttcgtgtgctatgtctgtagtcatcacttcaccaccaagggaaacctcagggtacagtttcacaaacatctccaagagaaggtgaacccccagttgtttgctgagttccaggaaaaaatggcaacaggcaatggcaacccatatgcactctgtacctgcccccatcaatgaatcgagcctctctttaaacagcaaacttgtccttgtaacttcctctctaaggctacctcagaatctctcttcagagactaacccgaagaacctcatggatggcctgttgcccaattacctgtagcccagtccttctgcagaaagtgagggcaggcctacactccttgaggtaaggacaaacaataattcaccaagtactggtggcttctaagtgagtgggacccccggccaggaccagagaccctaaaattgctgtagctgtttgagaacatccacaatgccgccactggcttcattttctactgattcctaagctatctcaaaatgtattactgcacatgcacccacacaccagggagagactattccagtataagatttgtggctgagctttttctaccaaaggcaacttgcagactcaccttggggttcactgaaccaacacacccataaagaggcagcattcatgcctcatctgccagagttaccaatgccgtgatattgcaacagcatattcagatgcacacgggcagtcagattcccaatattcccttgccagaggatccctgtgaccttatgatcctgatccaatgatggtcagtgaggatggcagtacaagtgccatctgctatgatgatgtccccaaaagcaccgatgtagaagtcagctcccaggagggcccaagcagctcctcaaagatccccgtatctccttccatgacggcttccttagatgccccaggtagggggagtgggtcctatcccttttggcctgcagtgccagagcagccaaaaaatggttcagtggagagcaatggcttgaccaaccactcatcctcactgaaatgagactaggagtgtgagagccaaagtccagacaccatggaaactaggtccttccaggtactctctggccaatagtgaggcacaaatcatcaagtcaatgtctcctgatgctgggggcaaatcagagagctttgagaacagatgcagggatggaaggttggagcaggctcccttcaacgtttatctgagcccagccaacctatgtcaaacttgaagttccaggtatatttgtaggaccctcaatcttgtctccagggatgacccctttgttagaggcccagctacactgacaggtcaagcaacacggctgcacccagtgtgggaagaacttcctgtccactagtcttttcagattcacagacagactcacactggagagaagccttttgtatgcaacatttgtgggacagcttttaccaccaaaggcaacttgagggtctactatatgacacatggggtgaacaataactcagcacaccatgggaggaagctggtcctggagaacaccatgtctctgttaggtacaaaaggaaaaagagtctcagaaatgtttcctaaggaaatcccagcccctttagtgaatgtggacactgttgtaaggaatcagtatacccccacacttgactgtggtctggcagtgaaaaccagtgagctctctctgatccagtgtagctgtattcctaccctcctggtttccttggaggctgtctccatcatgaataacaccaccatctccaagatgatggctcccaatcaggtgtcattgcggatgtggaaaaaccaggtgctattgacagcattcccaaacatcagttcctttacttcctggaagaaaacaaggttgcagtcttctttttttttcttttctttttctttttcttttttttttccagcttagcttaacttgcatggaaggataaatgcagacagagttaaatctctagaatctgcttttttttttttttgtaaaggcccatctcctcctgttttctttcttttttatttttatttttttcgagatggagtcttgctctggaggctggagtgcagtggcgtgatctcagctcactgcaatctccacctcccaggttcaagcaattcttctgcttcagcctcctgagtagctgggactacaggcatgtgccactgcatgcagctaatttttgtatttttagtagagacagggtttcatcatgttggccaggctgatctcgaattcctgaccttgtgatccacccacctcggcctcccaaagtgctggagttacaggtatgagccacccgcgctcggccttctttttcttactggtatgcaaatgacgtttatgaaggttgtgaccatcacctcaagcacaattgaaatgaaaatgaaaaaaatgaataaaaaattataccaaaacaaatatacactggatttttttttttaagcagcaggtgttgcaaagtagccttgttacttgtgacaaactatatacataggactttcgtaaaacctatggtgactttttctaagaccattatctacttcaaggtggaatcattggaacttattgaaccacagtggaagagacaactacttagcctaattggggtgaagggtattggtaaccgtatgcaggtaaacggacaagatctgtcatctatttagggaactgttttatattcccccaatcctgttaacatctttctttttctttctaaaaatatacttttaaaagaacaaaaaactaaggttgtacaattataaaattgcttcaaccttagaaccttaagtaggatgccctcagatggacttatgttagtgcttagggattcattgtgtgtgttgctgtttattcaaatgcagttcagtcagaaccgcaagagtgccaatgtcctcctcatacttcccaaatgcctttttcttcctgaacctgaggtggacacctgaatggggaatctcaggtgacttaatttagtttgtcggtgcctaccctattgaaaaaccgggttttcattcttgagaagaaactcatggaagggtgtgtttcctgccataggttcacacactatttttttgttttgtttaatttatttggtgcaacttaggaagattattttttcttgaggattttatgaaggctgtgaagttggaacaggtgagtcctgggtaggaaagcttttatttatctcccttatttatttatttatttgttttttagccatagtctctattttcctattttaagactactgaagtattcccaggttctgtcttaaacctaaaagtcagtgtattggtggaaagagttggatgttcaaggtgttttgtgattcctttatttgtaatctccttttgtatatgtaataatattgagcaaaggaaacatctctctaatggtttaacaagaaaggagaaagaaaaaccctaacttctgggagaagtctatcccttctatgtggaaggccctgaatgaaatgtagatcaagactgttagctaatgttttgcctcttggttattgcacctgattttaggcctttttatttttttgccatttgtgcctttccttctggaattgtaagtgaacacaataatggtatctgcttatactgtgaagtgtgtattgttacagagaccacaccagtggctttttcactgttgagctaataatgccttgtgaatgtatgatctttggagaaactcctgtagctgtgctgctaatgctgtctgtctgttggaaaataaattttgaatgttttctctttggaaaacatgtccacaaatcacaatatgtgactcttaggtgaattctgaatcagataagctgtaaaataattgaaaatgtaaacacatttaccaatttggttgtgttttaaaaaagtcaaaatttagtgatagtactaaaataagcaaaagcaaaataatatgatattttacaaatatatgaatggctttaaaaaaataaatgaatgagtaaatgtagttggggcataaataaaacaagattgaccaagaatcaatatttgatgaacatgggtgatgggtacatggggtttcattgttccatactgtatacttttctatatgtttgagaaattttctttaaaaaaattaaaaatagaaattggctagattcaaatcctgtcatctccattgcagcatgacttttgattctttaacctgttgatgtctcagtttcctcatccattaaatggtgataatagaatttacctcgcgaagtcgagttgagaattaaaattatacatatttacatacacctatatgtttaaattaaactatacatgattttatacagacagttttcgcacggtacatagcatggcatgtcgacgcagtagagactcaatctgtgacagccaatgttaatggaaagggtggaatttgttcagggcctaaatcagattttcaatcatgtgctagtttcataacaccacactgctccttgacacgtttttcaaaggaaagagccaaaactcattgataaggaaaggacatcttggcactgcttgaaaatcaccccaacaggtccctaaatccccatttgcagctccagtaaatatccccatttgcagctgctcccccaccagtacctaccctgctgctaaggcccaggccctgtcagagaagcagcacatgacggatgtttaacataaaagtgttttcagggggcaggcagggctgctttaattcccctaactaggtaatttaaggtatattttctcatatttgccaacagaccaaagaagaaatgctctaagatgtaatcaatattcacatcagccttcaaaccaatttgatttcagtctttcacactgttgaaataaacaaccctgtgaagtcccacacatcaagataaaagccaacaaagaaatggcatttttcccttgagcaactatacacctaaaagatgacttgtgaagcaataaatataggttatggagattttcccctcttactctaagagtacataaacactttaaaatgtatttgagatattattgattgctgaattaatatattttgtaagatgaggtaattattgacaaagaagatattctcatcctgtattcagtttaaatgcaagctgtcatacaaaaaagagatttaagaggagatttataacctgctccaggaagctaggagaaggtttcatccacccccaaagcgcagacacctcctcactcttctgcttgttcacagtaatatggatgccactgtgtctggtcacagatctatgtctctgcttaaattgtccccattgcacaaaatgtcctttctccatctccacagactaaacttctgtctcaacctcctatgactgtacttttggaaaggaaagtggggaacacagtaggtgagaaaagacatctgttttgctggttgataatctagaagatgtggtctagacattgaattattctcatttcataatttataagaacaactattaaaatgcccagtggtcctggataatgtatagtcaccattcttatcttacaagacatagctgtcctgatgtaaagatacaacgtgtgtaatctttccttctctaaacttctcaatcactctttaatctttgttgctacttaccacttgatatgttgcattttgtttctgaaaattcatgtctataactataccatgatcagaatggctaaagtgaaaaagactacactaaatattgacaagaacatggagcaacagaaattcacatattcggctggaaggaatgtcaactggtacaatttcaaaaacatttggcaatatttactatagctgaacatgtgcattccctgtgatgcagaaattcaatttctacctatatgcccaataagaagttacatatattcatttgtaaaacatgtacaagaataagaacatgtattacatcagtgattataatatcctaaaactggaaagcaactcagatgcacatagcagtttcaaagataaataaagtacgataatgaaatactacccagcaatgagaatgaataaacttgccatatgctcaaggcagattgaatcacacaaatattactgagtgaaaaatgaaagcaaaagaaattcaagaaaaggcaagactaagctatgaagttgtaagtcaggagagtgaagataggggctatctttacaaggagatagtgactcagaaagagtacaagggaggcttctggatgctggcaatgctgtttctcaatttgggtgctggttacataggcgatttcactgcctatgtatgaaaattcaccaagctctacatttaagttttgtgcactattctgaatctatattatactttaaaagtttttaaaagaaaccttatccatcccattgactaaattttgagaacatacttcttattcaatccatcttcatagccccactgcccttcacattagccttcatttaaaacatgcttcataattgttttctcaataaaggactgagctacatgtttaaaaagatgctccggtcccaggtcctaggatctagtatgttatcagatggacttgaacttccctgtgtagcttgctaattactgctttgagtttagacctttggtattgatgtggtttttctctgtctccactcaaatctaatgctgaattgtaattcctagtgttggaggagaagtctggtgggaggtgattggatcatggaggtggcttctaatggtttagcaccatccacctagtgctctctcgtgatagagttctcaagagatctggttgtttgaaggtgtgtggcacctccccctttgctctctctctctctctctcctgctgggcatgtgaaagtgtacttgcttctccttcaccttctgccatgaatttcttagtttcctgaggcctcccagccatgcctccagtatagcctacagaactgtgagtctattaaacatcttttcttcataatacccaatctcaaatagttctttatagcaatgtgagaatggtctaatacaagtatgttacacatggttttctgtaacaggcttttaactggcctccctccttccagcatttcctccccataatccactcccataccctacaaatgacttattcttttaagaaacacagcatcaatcacatcagtcctctgtttaacaaccttcaatgaccatccttttcctgtaggagtaaggttagttaaaactcatggtgtagctctcgatggcctctacagtagtcatgaactttctgcttcatcagattaagtctaacttgtgaatgaggctgggaaacatttactgtcctccattaacagctctgctcatagtcctttgctcccatgattacacctgtctgaatgcttaccatcattctttctcctgatcctagagactatctcagaccattattaccttgtgaagaattttctggtcaccccagctcacagtgatctcttccttctgataaattaccccaaatttttaaaaaatatatttcaaaaaatctttttttcaaaaaatatttttgaaatgtatttttatatattttatgtatgtttttaaaatatagttcacttaattttacagtgcacttttataagcattatctcattcactgtttataataacattgtgaacaaggcaaggtacaaagaattaatctcattttgtagcttaaaaactgagattcagagaagtgaaggggcctaagccagtgtgctcagccaagggtaaagctcactcttctcacccgagctctctataccaaattaccttattatgagtatatacgttatctcctcccaaatatacatttttttctaaatgttcttacacgtttgtatgtctcataatactggacaagacatttacggggctatgtagagctgagtgattttatttcaatattgttcccagcaagctcaaggactgacaaagctgtaccacctctgctctatgggactactgtagcaaaaactgaattgtagaaaaaaacaatcactgcatctccaaaaaatctgcttttggaagtaagaaagagacaagaaaaataatcttttaaaggtcagggcagccttaattttacctttatatcctaggctccaatattgaaaagtttcaaagaaggctatcagaggtaatgacaatgggcttcaagaactacaaatgaatcacaatgaaataagtttcaaattgatcaaattccagaaaccactcctcagataatttaactagtaagcaaaatggagaactttttgattttgaagcccagtttaacagaatttaaactatattaatataaaacttaattttctttattccaaaggctatattatactaaatctttctggaagctaaccacaggactaatgtgatgaaattgaaagaatggggaacaaactaggtggatgtctggacaccccaaactgaaggtaaatgctaccttctaccctaacattcttgacttccacaaactcaggtgttagacacctgagcactggaagttaaacaggtagatatgaagactaagaaaagaagagggagatagagggaccaaaataaatctgaatattgtaaagaaggtattcacacagtctttatttgcctagtgctaaatacatccagtgtctacttctagtctgacccttcattccaaatgcctgtgtctgggctaacgggagcatagacagcgaatagaatttgctttactgtctgatcttcactcaagtgaaagcaatttgaggcaggaatcatgttttgttttggtttatgtgtttttttgcagagctttacatgtcatgtaagtcggaatttctggaatgagtacttaagcttagggattcctgagcatgcataaacatttaagagcggctaggtgatctgtctagccagagaatcttgtcagcatgtaactgtactcaagaccacaattttactaagagttgaagtgtgtaggtaattttaactggtgagaaaattcatttaggataaatatttattatttgaagattatttttatgttcactttatttttgccatagctattgttactatactgacagcacttccaataagaacctgtgtaaaaaaaacaatatagtggtcctcagtaaaaaagtcccaatgctttaaaatggtttatgtaggcagagaactatgctttaacttcttactataatacaaccataacttgcataaagtaaatccaatcctagagcaattatgagctatgaattctgctggtcttatttcattagcacaaataattttaaaagggctagacaaacaggccaacagatgtcgagcaaacagaaactttaactgagattcctgaaatccctaataaaacaaataaacaggagacagccataataaaataaatgcctctgtaatgaagagaagtgtgtaatagtaagcatctaaacctggcattataaaagaaacaaaaagtaaaaagatggtgtttcgaaaaccaagttactaaagtaaggttacctatttatcataaggctaaaggtgtaaggctgctgtcatccaagtatgatccagggaaccctagacagaccttttagggagtctggcattccaaaactatttttataatgataataagacattatttgccttttttactttcaaagtctcgcaggtgtatatgcaaggtttccagtctacatggtatgtgataaggtcatcactctgatggttaatggaatatatctctacctctatctctatgccacataaacacaacctctttagagtcttcttggaatctctcagtgaaactataaagggatcctgagaccaacaagtttgagaactgatggtttacaggctacaaattcaatttatcacaatatgactttgaataatattttaccacttcacacacagtgtaataaatttacagcatttcacctccattctttgtgctattgttgtcaacacatttttattctacataagttaaaagccccacaatgcagttttatggtttttcctttaaaaaattatcttttaaagttttttttttagcacttcaaagtttggttctgacatacattgtttctgatgaaaagctggctgttattcttagctttgactccccatacctaaagtgtctttcctcatttttctatcctgtcaccccaactgctgttaaaattttcctttttattactggttctcagaaatttgattacaatgagccttggggtaattttctctatatttcttctctgtatctacgaaaaactttcagccattatttctttaagtatctttctttctctccctctcttcttctgaggcctcaggtacacctattttagattatttgattttgtagagttcaggagcactatttctttttttaaaatcttttttctttgcttcagtttagatcatttctactgctttttcttcaagttctctaagctttttttcctgtgatttctaatctgctgttaatcttgtccaacttatttttcattttatttaattgttttttatttctacaagttccacttggatctttttacgccttccatttttctcctccttatgtttctatatttttttacatccttgaattcatttttattgtatgtatgtagtttatatgcactgttttaaagtccttttataataatcacataatctgtgtcattttaaattctgtttctgtttatctttctcccggttatagactttattttcctggttcttcaccagcttgataattttgattgggtgctagatattatgtattttacattgttggatgcacaatttttttatattactttaaacaccattggacattgtactgattattaaataatttgcttatcattttgattttttgagacttcttttaatttttatctgaacagcctctattctgggactaattaaagtcactactaatttatcacctttctgaggattctagtgcctgccctgtgcattacaatgtctcttgaatcctggatgctagtaatacaaactatgcccagcactatgtgaactctggaaattatttggcctgttgcttctctttgcctgagtttcctctcatgtatgtacagatcagccaaagacaaagagtgacccctccagagccagagttctcttctgaatctctctctccccctctttctctttgtctctctctctttttctctctccccaaatccctcctctctggtacacttattcatacattctagatgctttaggatccccaatctcctattctattcctcaacacaacgaggcagctgtgctgtgttgtggttaatcctccctgtgctgttgcctagaaactgcctccaggaaataagtggaagaaatgttaggactcacttcatttattttcattatctctgtattatctgtagtccaaggtctgaaaatttcctttattttgtccagctttttaatttgaagatcaatttctgtagcagtgtacatttatcaaggaaacaaaagtcaaagtaatttatttgtgttgtattttacagttgtagtggtccatgataaattggtgaaaacactgattctttatcatagattatttgaaaagagccacattagataatgtttctaacatgcattatcatgtttataagatgacatgctgattgtgtcttggggacttaatagaactgattcagataaaggaataaaggagagtagagaggactttctaggcagatgttctctgtcccatgagaaccataaagacatgtgcaaggaggaggcctcagatttttctacttaaaagttgtgcctggaattatttgggattattatctgtacccaaggagaaaatgatgcgagtaataattgaacattgccccaattattgctgtgaatctataaaaaatgaatgtttagtgctttcttcttagagtcctattccattcttcttaggtatctaccttcccttcaagctattttattaaaaacagggtcaaggttctttttggtttttattttctccaagatggtggattggaggcatcgtcaacatgcttctcccacttgggaagacaaaatagtgtgtagagactcacactgtgaactttcttccaagaagcaacacaggaacttaacaagaaaatggaaagaaaccacataccctttgaatgaagcagcaagttggctgggcacagcggctcacgcctgtaatcccagcactttgggaggccgaggtgggcggatcatgagatcaagagatcgagaccatcctggccaacatggtgaaaccccatctctactaaaaatacacaaattagctgggcgttgtggtgcgtgcttgtagtcccagctactagggaggctgaggcaggagaattgcttgaacgcgggaggtggaggttgcagtgagctgagattgcgccactgcactccagcctggtgacagagcaagactccatctcaaacaaacaaacaacaacaaaaagcagcagcaggttgcagcctgcactgtgagctagttggaacactctaagtccccagagtgtgagagggttagaaactgcttctgggatatacatgcccactggggaacctggcaatccaggctacggggaaagacttaatcctaccaagccctagagctgatttagtgagccgcacggggtacatgagaaggagcagcattgggatgtgctttgcatgcattcccagtctccagtggggacagagagaagccatttctgatcctcacaggggacctcgcagacatctgccagctagctcaggtggtggttgagagaagctcccaactgagatttgcaatataatctcgagtggggataaactcctttagcccaaactcagggacaagcagaaagtgtactataaccatgagcacaggagctaaatgcccctgccttgcaggtggatcaggaggggcatggcctgaaaaccacagtttctgtctctatggggaagccttgtggcctggagaagctttgagttctgagggcagactgcttggaatctagctagctgctgatagtgaaacactgcaggtgtgagacctgccttgccaagtgtgtaggggctgagggaggcttactgctgcctgctactccccactccctatgtggaagagtccacatggggaagtgccttctgtgcaatagaggcagctgtactcctctgcttatgccagcttgtgcctccacttgtgccagcacgcagaacacggacttccctgacccagccccacctagctttgcccctccaccagctccggttgcttaacacaaaggtctgagtcttttaggagctatatcgcccttcccattgcctgagacaccaaagtacctctcccagtaacataaggcaagcacaaatcccaccattattaccacagttggtagtcctttgcaagcactatctcctggctggaggccaaccaacacagtccttcacagcatttgtagacagaataaaacagcaccaagaaagaggaaacttgagtgtgatctcaactatcaccattgcctgcagcaccctggctaaccaggaggtcctcagcatgtccacatgatcagttcgtttactagtataactggcatttgaggaagccaacacactaaagctattcataactaagcaatctctcagagtctaagtcactctcctgccactcccatcagagctagtgctggtagccacttccgggagacttgagaacaggtcacatcactagatcccttgcagacattctgcagcaacagcctggaggtatcagtcccactgggtggccagatccagaggagtagcagcattcacagcagtctggctctcagggactcctacttctaggggtaaagggggtgcactatatcaagggagcaccctgtgggacaaaagaacccagatggccggtcttgagtcccagaattttctgctttgcggaagtttctttcaacagagtcacaggtgcagtgctgagctcagcagggaaagcttgtggctctaactaaacagtcagtcagccctggtgctagtgaagggtcttgaaaagtagaattctttttccccctcatccaccactgcagacacagctggaacttctcccacggaagctcagtgtgggtgcatctgtagacaacctttccagaacacttcaaggtaattgcatccccacaggaaaaatgccttccaggtttagtcttacacaagggggagagtcacaatccctgtctacatggaacatcagcactcatgcaggtgagaagaggtgcctatacgatctgtatagctggaacactgggccagcagtatgactgggaggtggatcactttcctgctggactggcagggtagctgaggaggctctctccttccccttgaagaggactcagtgcatttcactgagagttcccccagctgcttctgtcaaggctgggacctctgcccacctctaaatattgcatttacccatctgctttagccacagttgtttttttgttccccttggacatctcttactggtctgaagcctgaactgttccacccagtgaataaaatactggggaaaaaaagtaaataaataaaagggtgcacaccactggagaatgagacaagcgtcaagacgcctctgccattcaagccccacaggagacaatgaacctgctcacatactgggaacattgctactacaaccagcatccaagaaagctgtcatacaacggctttctataaccaaggagctcatacagaattcatctctgaaagcacccagagccaaaccagattataataaactataatcaaagtcacatcctcaagggggcaaaaaagaaattaaaaaacccacaagtgagtaaaaaataagttaaaaaataattagaagaaatggtctatccaaatacaagaagtgcaaagaaccactgggagattcaaccatacacacaaaaatgtgacccatggtcgaaagagaaaactgttaataaacccaaaaagagatgacccaggtgttggatttattggatgtactttaagataaatataataaaatacaaatggatctaatagaaattgtagacaatatgcatgctgagatatgtaagtttcggagagagaagaacaaacatatgtatagggaataggttaaccagtatatttaaaaatatgtatacaaaatatgctaaccaaaaagaaagattgacaaataggacacgaatacaattttaaaatggtgctcatccaacgacagtattaagaaagtcaattagcaacctaaattctgaaaaaatattcaagaagatacagctgaaaaaatattacttccagaatatatttaaaacctcccataaattaacaattaaaaattacacaataataaaatacataaatggtgtaacgagtgagtactgctatagactgaatgtttgtgtccccccaaattcatatgttgaaatctgttgtgattttaatttatgtcttttttttttttgacggagtcttgctctgctgccatgctagagtgcggtgacacaatctcagctcactgcatcctctccctcccgggttcaagcgattcccctacctcagcctccaagtagttgggactacaggtgtgcgccaccatgcccagctaattttttgtattttagtagagacggtttcatcatgttggccaggatgatctcgatctcctgacctcgtggtccacctgcctcagccttccaaagtgctgggattacaggtttgagccacctcacgtggccaatttgttatgtcttcttaatttggacttgaagtctctctcctgagaatgaccataagccaagataaccactgcctaggacagccttgactaggggaaaaattaggtttaggtgtgtgggtcaggtaaaatggaatggatctttaaaacttcatgttgagcaatagaaaccaggccctcctcccaacatgctatataaggacgtgaagcgaaaaggcataaaatagaaggaatttatttctcccaggtcccagagaggttataggtgccagtgggaggctgatgggaagttcagaggcagcagggagctcaaccagtaggtgaagagagagagaaacagagggagagagaggcctgtgggattatacgtttattaaggttcatgggtattatcccttaggcttatccatgggtactgaggactgtctagttcaaagaaaacacataaaaaggggagaaattatgtacacgactctggcgttggccattagatttatcatggttagcagctgtggaaagtgttggattttgggtcagtgagatgaagaacaaccatacagggagtggaagttctaactaggccaagggagatgaagtatgacttatgtcaggcctgaaaatggacgccaaggcagcaaccacattaaacaaacttatgacagaactgaattaccagtgtggtcgtatttggaggtgcggcctttaagaggtgattaggtaatgagaataatgtccatataaaagaggtcacagagagcttccttgcttttttggcaatgtgaggacaccgcaaagatgactaccaacccgaaaacacgccctcactaggcactgaatcttctgggagcttgatcttggactatacttcctccagaactttgagtttctgtttttataagccacctatctatgatattttgttacagtggcccaaatagactaagacaaatctataaaatatgttaaacatcataagtcattagggggatgcaaataaaatctacattccggtgccattcatccccactagaagcactaaaaacaagccatctgacaaccccaatattggcaaatatgtggaacaactagacagttcatgcagtgctggcgagaatgtaaaatggcaccgcacaatcactttggggtcttgcaatggcccagcaagaacactcacagatatttagcaaagataagtgaaaacataggcccataaatgatccatacaaaaaattttgtatgcacctcatttatatttgttgtaactggaaacaatttaaatgtccatcaacaggagataaaaaagaactacggactgatacacacaacaatattaatggatctctaaagccttgtgttgagcaatggaaaccaggcccttccctcaaaatactgcatgataccttttatataaaatacaagaacaaaaactaaactatggtgatacaagtaaaaatgtggtttcctctgggaaggagagtttgactaaaaaggggcacaaagggatttttctgcgatcatggaaatgctctacatattgttttaggtgatagttacacaggtgtataaaattctcaaactcattgaaatgaatacattgtatctgtgcattttattatgtcaatcatacttcaatacaaaagaaaccaaaataaaataaaataacctatatagaaagaaatgtgcccctgcacaattgtagggctaggtaagttttcacaatttggaaaagcccatgtaaccagcacccatatcaagaaaaagggcattacccacatggcaggccactcttgtacctgcttcctgtctctaccagcccaagtaaccattatcccgacatctaactgcacagactagttttgcactttaattaaatgggatcatttagtatgtactctggtttctagctaattttacacaatcataactttatgagatgtatttgtattattatgtgtagccataaatcttcattctcagaactttggggcattttattgtctttggtcatttcatttgtgtatatttagcttcccagggcaaattaatgaccagctagtctttgttgattccaagtctcagacagctatcagagtagactataatcacgacagaccacagctgctctagcaattggaaaagtatagacaaattcctgcaaaaactgtagaaagctaaaaatattaatttttctctgtgtatatattattttattttggttcttttttatgaggtataattttttctacaatgaaatgcacttacatgtttagtttaatgtgttttgagaaccatatacacccatgtaacaagataatatatagaacattccctacatccctgaagtctcctttccagtctaatttttcctcctacagacaaccactttctgataattttatcactagttaaatcatcctggacttaaaaaaaattaattttctcataagagggactttaggtcattatattatattcaattatattcactcaaagaagagagcataaacagacaattaaaagctgcagtcaactgaatcacactcacatatctgcacattgacaccacacaaatcagtcaccaactttcatgctgctgaaaggtaaaactatagagttgcccccagtgaaaaaagtctttcagccacatctgccgcagcagtgggctgacagagggatttgcaatgttccaattgctttatttatgatataagagaataagaatgcatgctctgatgagtttggctgcactcatttagactatcgggtgcaatgtttgaaagccagatttttcctagcacagacttactattgattgctattgggcacatgcaacgggacaaattttgtcaatcaagaaacttgctgtaatgccattaagcaaacaagaaactttatctaatataaattttcccagaatccaatggcttggtgcacaggaagaaagagttataatgattgagagtgaaaagttttatctccctgtctggaagaaaaatctgggaatatatttcactgtagatttcagccagagaccaaaaagcatacaccatgcaaaaagatggatgataacttgttctcagtagtcatcataacccataataaattgttatttcttatgaaacttatgagtctatctctgatgcattggctgaatgtagcaaatggttgaatcattaaaaccttcaatttaatttaactcatgtacatgtacagatataatttctgtctattaaattaaaataagaccaaataggcaggttagaatctccaactgtgtcaaaaagctatggcttaacacaggcaaactgatatcagcagatcacattttctcttctggcagaggagcaccttacagctcggcactcagaagaacttgcaacattctgctcccctgcctactgaggatagtcatagcctctttctgacaaaggatggtaaagatggccacaaatgcaggactccggcttttctcagctttaaaatctgggggcagcagcaggttgttattttctcctaaacctgatggggtttaggggaaagaggtaatggacagggagtcacagccccgtcctacattatttccttacaacctcatgggtacccccaggagaatcagcataattctctctcccttccccctctctcatctcttttctctctctttttcaggatctagctagttccagagggtaactcaagccctgaccgaaatttatttttatgctttaagttctgggttacatgtgcagaacttgcagttttgttacataggtatacacgtgccctggttgtttgctgcacccatcaacctgtcactcttctaatgttatccctcccctacccacccaaccccaacaggccccagtgtgtgatgttcccctccctgtgtccatgtgttcttatagttcaactcccacctatgagtgagaacatgcagtgtttggttttctgatcttgtgatagtttgctgagaatgatggtttccagcttcatccatgtccctgcaaaggacattaactcatccttttttatggctgcatagcattccatggtgtataagtgccacattttctgaattcagtctatcattgatggacatttgggttggttccaagtctttgctattgtgaatagtgccacaataaacatacgtgtgcatgtgtctttatagtagcatgatttataatcctctgggtatatgcccagtaatgggattactgggccaaatggtatttctagttctagatccttgaggaatcgccacactgccttccacaatggttgaactattttatagtcccaccaacagtgtaaaagcattcctacttttccacaacctctccagcatctgttgtttcctgactttttaatgatcaccattccaactggtgtgagatggtatctcattgtggttttgatttgcatttctctaatgaccagtgatgatgagcattttttcatatgtctgttggctgcataaatgtcttctttggagaagtgtctgttcatatcctttgcctaattatttgatggggttgtttgcttttttcttgtaaatttgtttaagttctttgtagattctggatattagccctttgtcagatggatagattgcaaaaattttctcccattctgtaggttgcctgtttactctgatgatagtttcttttgctgtgcagaagctttttagtttaattaaatcccatttgtcagttttggcttttgttgccattgcttttggtgttttagtcatgaaatctttgcccatgcctatgtcctgaatggtattgctcaggttttcttctaggatttttacggtcctaggtcttaggtttaagtctttgagccatcttgagctgatttttgtataaggtgtacggaaagggtccagtttcagttttctgcctatggctagccagttttcccaacaccatttgttaaatagggaatcgtttccccattgcttgtgtgtcttgatgggaatttctatactaccaggagaatcactataattttctcactcttcttctcctctcctctctcctctcctctcatctcctctcctctcttttctctctttttcaagatctagccaatcccagaaggtaactcaaacccaggctgcaatttctatgctgcagaaggaggctgtgaccttggattgtgtataagaagctaaaacttaattattatttactctggtacagacatccaccaagtgggagaattattttccttatagatcaggagtcttttaatgagcagaatggaacaaagggttggtattctctgaacttgcagaaaccagccagttccatcagctgtattttcacagcctcacagcttgaggttttggcaatgttctttcatcccctgagtgaaactacagtgaaatattcacctgaggggggcctaaaaaattcatatctcaatgtcccccgatataaacacctgggcaagagtcacagtgtgaacaggaagaggcagggaggcactgtcaatggagatggagatttaggagaaacttcactctaaggaaaatgttctctctggctcagagaacatatcttaaattgtcattaatcaaaagcgtgtttatcttcagttctttatcttgaagtagattattcggcaaaagatatatatatatgtgtgtgtgtgtgtgtgtgtgtgtgtgtgtgtgtatatatatatatatatatatttttttttttccaagatggagtttcactcttgtcgcccaggctggagtgcaatggcactatctcggctcactgcaacctccacctcccgggttcaagcaattctcctgcttcagcctcccaagtagctgggatacaggtgcacaccaccatgcccggctaatttttgtatttttttgttaagtagaggtggggtttcaccatgttggccaggctggtctcgaactcctgacctcaggtgatctgccagcctcagcctcccaaagttctgggattacaagcgtgagccaccgtgcccagccaacaaaagattttttttagaaatttgtggtgactacattaaagtgtgaaactgactcttaaaaagttaagaaacacttggccaaatccatatgcgaattgttagatgatttgtctgtatattgccatgacttgctcttcttctttttatatttttttctttcccgttgagtgacctacttgatttacttaatttctgggtggatattccttccattacaagtcctagcctaagacttaaggaaaatgagcttgcttttctactttcctgactctggttccaaaggccgaattatttccattggaataaaaacttcttgattcttaacccttaaggagacttttagaaagtattatcctcaattgtaatattggtcttttcaaaattcacccatgagagcaaaatcaggaccctgttctgggaagaagcatgactacgtcccagggagccaggccatttggccatgaaactgtgattgtgaaaagacgtagatgaaagcatatgactttcacaaaaagtaatgacaagaagagggatttcttattcttgggacaatttggagagaattagtcttttcttcaggaaacatgtgcctaaatatcagaaaagaagtcatagaagaagaaagaaaatctcgttttcagttcattttgatgacttaaagatggatgggcaattttcctggggaatattaaggtttaaaagaacataaattttaggaaaagtttccagttattctcaataataagacagatataaaactattttccaaatctataatacaaaattgccctgtgataaatgacaggaaatttccgaaggtgatgggttgaaaacggtgtgatgtggtccctatatttctaaattaaattttcaggtagaataatcatagtgagataaaaaggaaatttttcagcctcaaaatataaaaggttttaaagtcatctattaaaagtctttgatatacattttggttattcaaagcagaataaccactgtacaattccatttatataacattcatgaaataacaaaattgtagggattaataacagattagtgattgtcaggggttatgactggggagaaggaatagctgtggctattaagataaaaataatgaactattcctcctatccaaaaaatctatttataaataaacatcataaaaaataaactcaaagtgaatcatgaaattaaatgtaaaatgtaaaactgtgaaacttttggaaaaaataaaatcttcaagatgcagagccaagcgaagagttcttaggtttgacaccaaaagcacaatacacacacacatatacacacacaaattggatttcatcaaaatttaaaacttttgctctgtaaaagatcctgttaagaagatcaaatgataaactacagactgggagtaaatatttaaaaaccaggtatctgacacagagttgtagctagaatatataaagaattcccaaaatgaaacagtaaaaaaaaaaaaagttagaaaatgagcaaaaagcattaaacagatttcactttgaggatatacatattgcaaataagcatatgagaagatgatcaacattatcagctatcagtgaaatgcaaattaaaaccacgatgagatattattatatacctatcagaatggctgaaataaaaaataaagataacatcaaatgctgttgaaaatttagggaaactggatcactagtatgttgttggtagggatataaaatgatacaggcactccggaaaatagtttagcaatttcttataaaattatgcatgccttaccccatgacccagcaattacactctttgggacttatcctagagaaacaaaagcttatattcacaccaaaacctgtacatgaatattaatagcagctttattcatcacagcccaaatctggaaacaacccagatgtcttccagtgggtgaatggttaagcaaacagtggcacattcataacatagtctattatatagcaatacagaggaacaaaagcatttatacacataataacttgcatagatatcatgcttttatccctcatgcagagtgagaaaagccaattttaaaaggttactactgtacaattccatttatatgacattattgcaataacaaaatagtaggagtaagtaacagattagtgattgtcagggattaatgatgtggggaggggatgggtgtggctgtgtgaaggagtagcatgaggaaagctgtgattgtgaaaccattgtgagtcttgattgtggcaatggttacatgaatctatacatacgataaaattgcatagaaccatacacatacaaattagtgcatgtacaacttcagaaacctaaataagctctacagattataccaatgtgaatgtcttggtttagaaactgttctatagctacacaagttgttatcattggggatgctaagtgaagaatacgtgagacctctatatacattttttgaaattataatactataattatttcaaataaaaaataaaaatatttttaaaaattaaacaaaactttgcataaaactcacaattctaaatcaccttctgtggctctgttacccatctatcacacattcagtctaggttctcttagttcctgcactaataaatataaatataaattgtccctgcattataaataaccctgccccaatcttgcgtttatctttcgtctttttcgccttttttcttaggtacatatattcagaaacagagaaaaactgcctattgaaaatgatttgtaagagtcagagtttgctaatgtgggtaaaataaatcaaatcagtcaatgataaattatatgcaagctagtgtaatgatttgtagataactgagaaattatcttattctcaaaaaaagtcaatgaacaacgtgtttatactgttagtacagtatatgctcggtaacttttttttctgctgaatggaagaagggttggaggagcatcaaagttaatggggactaggagcagactgctattggcacaaatccaaagagaattcgtgtaagtgatagataattcaacgagatgagcacatatttaatggcaaaatttacctacaaaattattggcatatgataaacacatctcaattataaagtccagtggtgtgtcatagaatcaaactaattaggcaatactagttttgccatgatatcttagcctagtattgctaatttcaatgttcttggaaaaacagtttaggagttatgtcagaatattattgaggttaattttcattaggtacctactcttttaattcagcaactcttatttttatagtagtgggtattgtctaaattatgattaccttgaaatttttatacatttatttgaaactagacatgctcactcaaaaatttcaatgaagactaaacatgtagaaaacgagaaacagtcttaaaacagaagggcaatagggtggagacaagttcgatcatacattaaataatattattaagctgaaataattaaaaatagttggcaatagtgaaagtataactagatagattgatagaagacagaaacaaattacatagagaaaattactgtactgcaaagatattactaatcagggagaaaataatagatttttgagcgcataatgttgagtcaattgtctagccacttgaaaaaaattaaccccttaccttattccttagatcaaaataactccaaatgataggcttaaaagattaaatataaaacataccagaaattttcaggatttaaaaaagtaagcttagagtgggtcaggttttctaagcaagaccaaaatttcaggagacattataaagatgaatgcatttgaatataccataaggaagagatatatgaaagcaaatatttctacgtggcaaaaatacaataaaacagcaaaaactaaacgccaaaatggaataaaaagcttcaaaatataaagtcacataaaacgtgactttaatatataaagagctttagtaaaccaacaaaaaattaactctccaaaagaaaattgtgctaatactataatagctaatgttacttatttgttacgtggtagccactattttaatttttatctaggtagtgtgtaatctacctgtctacctatgcatctatcattatcaatcaatatatatctgttggtttcaatacatatttcaagtgattctcacagtaattctttaaggtttgtactgttctttctccaccatccaatgataaaactaagctcaaagataaaactaagtcacagaaaatctctgagcaattttttcatagaaaataaatcatagagctagagtttgatcactggtattctgtctccaaaatgaacacttaaacataattttcaatagactattcaaagagagacatacaaatggattttaaaattattttttcaacccaggcttcagtaataatagagaaaattttgaaatggtattctgaattagcatttttcacctattaacttcagaaagataaaaatgtttaataatacattgtgttggcaaggaagtgaagcaatatttattaaatgaaaaatgcatgggttctctgttatcatttacatattttcaataatttttataaatatatttgttcatgttggcaaacatctttttatggggataaccatttcagcataatctttggtagtaaaagactggaaatgaaaatacaaaaatgcaaaactgtttaaatataatatagtacagccaaacaatggaatactacgtggccattttgcatggacaaaaaacaaggcacagaatgatatgtatgtttgtctgaaaataatgagtatgtacgtgtatgagagtgtttgaaagaacagatgcatagatgcctctataatgagaactgtgatactgaaggacagatgaggaggaaagacttacttttgctgtgtattatttatattgtgtaaaatatttataatttgcatggaataatctccctcgccacacacacacacacacacacacacacacacacacacacacacagtgactttcaggtctctctgaggtccagaaatggagacctcttttttctctctgttatgctttttcaaaacttccttccttctaatatctaccaattttgtgaccctgaattttggtcacagttggtctcaatcctgtagtcacacagaaaattatttgaagacatggatttcttaatttatgttccaaattctctgcacattgcatcagagaggtttctagacacatccacaagctatttgatcccctcaactccatcttttattttcagagctctagtctttttaaggtttcacctgctgaggttttgaggttttaaggttttaaggtttcacctgctgaggttcttgtgcattctagtgaaaaatatattttagtgagaaatataattacagctaccagtcggattcaactcctttgtaacttctggttgcagcttagctttaaaaaccattcaaaaaacaatctagagaattaagagtccaagtaaaataaggcttttctcattgccactttaaacctcatatgcactatgcccaccaaatatgaagaatatttttctttgtaggtggcataaagtgggtaccgtgggacagtactgtggccacgaggtggcagtggttcaatttactctcattctacaactgcctttaatttcaaaagcatgaaaattactagaggacttgcatttgattggttgagcagccaacagaaaggctctttcctgcattacagaatatgaactaagatacagaagtggcgcctctgagaaaagaaggttggaattatcgtaatttgtttctaggctgagataccagcatggagaaaatgttggagtgtgcattcatagtcttgtggcttcagcttggctgtaagttggaggttaagaaatgagaaccattcgtgcaaagctgaggaagagagatgaagatttaatctcagctcattcagttttcctgttggaatttttcaaagctgctaaactaaaagctttgtataatttctgattttgttttcctgaacagggttgagtggagaagaccaggtgacgcagagtcccgaggccctgagactccaggagggagagagtagcagtctcaactgcagttacacagtcagcggtttaagagggctgttctggtataggcaagatcctgggaaaggccctgaattcctcttcaccctgtattcagctggggaagaaaaggagaaagaaaggctaaaagccacattaacaaagaaggaaagctttctgcacatcacagcccctaaacctgaagactcagccacttatctctgtgctgtgcaggcacagcgttccccaggcacctgcaacttgtatcaaaaccctgcagctgaggatctgaaatgatggcagaggtatctctgctgttcttcctcttgaaggagtatttatttaatgcccaggacctttttccaaatggtcctttggagaatgaagtcatgagacaaagccagagggcagggactactgttcattctgtccaggcatcctagacagtcccttgtgcatgttcatgggtcagtctactcttaataacatcccagaacttccctcacataaattcagaagggccagatgtaatatgaagagtcctggtttccagttgcggactacttggaaaaagactgcacaggtgcatacactccctgccgaaaaaaaaaaaatgtgtgtatgtgtctgtgttgtctcacaataatctggtcacgttaatataagtaaatctttttcattttaatatagtcttcttgaaacccacatctccaccagccacatctctatatttctcatcccttcatcatcaaattacttgaaagaattgtctggactcattctcttaatttccattcttcagtctcattcaaacctggcccctgttagcattactccaagggaagttctcactttaacaccagcggttttggtattgataaggctatcagatatttttcagtactcatcttgtctaagatttgcagcagtctttcctcccttctcattaaaataaatgttactttaatcaaaataatactcacatatatttacaaaactcaacagcactgtctcacaccccagtcatgtctctccattctcaggtgatggtactcacatttatctgaacatttaaagatgctgtttcttcgctttcttctctttctttttgaaattgaggtacaacacataataaggtgaataaaactttagcttacagctcaatagaattttacacttctttgtatctgggtaacaccatccagacctacatattgaaattttccattactccagaagatttccacatgccccttccaattcaacggcccttccccaactctccacctggagtaaccatgattctgcctttcatcacttggtcttacactttgtgtgactggaattatattgtgcagcctatattctactgtctcaatttcttctctcaatatcatatctttgaaattcattaatgtttctgtatgcatgttattttaaaatttatatgtaaaattcccctgtataaatatgtaataatttatttttccattcttcttgaaatagacttttgggttttttagactgtttacagttttgtgccattatggaaaaggttgctataaacatttacttaaattttatttggtggacatataaactcactattcttgggtaattccactggaatggacttgaatggacttaactaggccataaaataggcatgtatttagctttagtggttattatcaaatgtatttcgaaaggctaccaagttgtatgctcttatgaacaatgtatgggagttttagttattccatgtcttcaccaaaaaatggtatcaggtttctttttgtttgttttttaatttaagccattatggtgacatgcagtggtatctcataaaattgtggttttaatttgcttttcctgaagaataatgatcctgagcaccttttcatatgctcattgtccatctggatattcctttctgtctagtacctgttcaagtcgtttgcttatttgtttattgttcatatgtaggcattcttcatagattctggctataagcccctgtcaaaaccatctattgtgaattctccactaatccattacttgactcttcactttcataatgattttctttgagatacagaaattcctagttttggtaaagtccaaataactatttatttttctttattggttagtagtttttgtgccctattgagaaatctttgcctacctcaagtaacagacacactttttttcatgtaggtccatttgccacctcaaatcaattttcgtgatgctatgcaaaaggtgtccaggttcctattgccccatgaccatttaatgaaaagatcttcctttcccccactgaattgcagtggtgtttgggtcacaaatcaggtgatcctacgtgtatagctctatttctgcactctattttgtttcttctgttagttcagcctcccagctatctcataatgtgcttattaatatagctttagaatagaatttgaaactcatcagtgtttttcttcatctgtgttcttccccttattattttatccattctatgtcctttctgaatccatacaaattttagaactagtttctaaattctaaatcattttcacatctacaaaattgcccttgcagttttgattggtattgcattaagcttatagataactttgaggagaattgctacctcaaaaatattgagtcattgtgtcaaaaatatagactatctacctgctaaggtcatctaatgtcttaagcaatgattttagttctcaatgtagtgatttgcacatcctgtatcagatttacttccatgtatagacatttcatgcagatttaaaaattttattttctaattgttgctagtgtatagaaatacaattggtttttacatattgaccttatattcattgaacttgctacacttactaattttaatcatttggtcatacattattttggattttctaagtccacaatcatgccatctgcaaatgaagaaaaatttgtttcttgcattataatctttgtatcttatttattttcctttccttccttattggccagacttagtggaagagttggccactctatttagatctgcttatcatcccagggaggcagggacttaaaaatgtaaaagatataaagtgagcgagtggtttatggagttctagctattgagtcaaagtaatgactaatgccctacttataaatagactctaaacaacagcatcggctctttccacctccgctttgtgtagaagaaatgcagggaggcctagaaaaaagggagcagaagtagaagcttcctgatttaggaagagaggcacaagtgttattttacccacgtcatctggttttgttgtatttaaccctttgggtttacagccttacagtttgcccaatgtgttcaggtgaagcgatacaaaaatcaccgaaggattcctgctttacctggtaccaattttgtcattctcatcatcatctttatcgtcacaaaaactatgaagtaatattaacccatttctcagattgggaaactgaggcttacataagttttgagatgaaagcatttctgagataaagtaaatgctgcaggtaccataaaataagacgaagaaaaacatataaaacttcagagttaaccaactagacagcacttctctaattttactgtacatttaagaatcacatgaagagtttattttaaaaatgctttatttccatagattctgattctataggtctgatacggggtcaggagtctgctttttttagtgagttgtctaatgattttgatcattagatctggagatcttactttgaaaaacactgcaactgggagagtactgcatttcaggaggatggatgatatagacatgcaggtgattttgtgttaacttagataacagggcttagggaaccaggaaacacacctgggaatgccttaatgtgggttatgcctattctgattaaactatatcctatcataattagtagaagatactttgttttgatgataaagaagggaatgatttttgtttcaacaacagaaatttatttatgatttgaaaagcagcagagagattaggggatagacaagccttttagttgcagactttccaagaagaaaataggctaaaacaatatatgagattctccactatgaattaaactttttcattctttattgtcaattaaaaaataaaacttctatatattttaaaggccataaaccaattatcttagtgtttccttcaatgttctaaaatttagacaggttttatctaattattttatttactctttttactctgcctggattctttacaacattttaactttctattaaagaaagttggttccaatactgttaaggctctgtttattacataatatagcacaatagtgctctaaactccacctttaacatgctcatataattccagtatagaccatgctaatactcataattgtttaatgaccatggttaatcttctgctgcatcctcatagccaggctttccttttcctgaatccatgatgagtttggttggtgtgaagactgtaattgacttttgtccccagagctcacctaatattatattcctaatattattggaatacaaatatgtctatttacatttatatatttataatctatatgttacacattacacatttatatttatttatatgttatatgacatctaattattggaatatatttttattttgtcttttggagaatttgttatggaatcaaacagacttatttttcccatgagatcaataggatatattgtgggacattttctgttacgaatttggcaaataggacccaaagctaggaaccaagattcattaggcatccaccatttttcattaagaatggctcacattttaagcacagctgcacttctcaaaaaatttttttaaataaaaaaattaaaaaaagaatggcccacagttggacattctctgtagaggtaagaagcagcaactgaacaggctctgcaacctccaattctcacctcttagctggtgtgaggaggtagcgagggatgggaggagtcaagaagagaatatcatcagagtattccccctttcccacaagccacttgaggggtcagtactccaaaataattacttccaaagacagagatctgctgcataaaaaggaacattgtgtgacattttcatctttgttctgaagcagattttaatctatgtttacatctacttaagaagaagacgaggaaactggagagagatggtggagtggagagggggcagccatggcctgcctgggtttctgcactgggcatggtgaggaggcacgtgtattctgtgggcaggtgctgcctctgaggtgccagggctgagctgtcccaccagagcttcacccagaggagaaagtaaggggctgtggagggttctcctgagggaggggctgacaggaaggggagacacctcccttgaggagcccctgaggtcccctgggtgctctctcatagggacactcaccatacacagccatcagtggtcggccagggaagcaacaacactagaggtgcacagtggttaagtaagaacagttttgttgtttcttccccttaatcttttcctttcaccttaatcccgggaagttaaaatcaaagaaaaaggaggaaagaagagaacaaagtaggccatgtccacctcactgtagctcgggatcaggcctgaagtttggagagcagaggaaaggtgaagactggagtgttaaacagaactgccctgaggtttatttaaccactgaaagtggcccagaggtttggagctttctttcctagacctcttcaagggcataaggaccagggcccctctgaaggacccaaccatgcttaagcctctttgatgctcttttctttggcatcctttcctctccctatcgctccacccagaaaatgtttatatagactctggtaggcagacttgcattatatctttgtatcatttcctataagtcagtttatgctggattccttaatttgcctataaagctgaaagttttgaaataagatggtaggaaagacttctttatttttggtttccagctatgcctcctttcctgaaagtgataagcagaaaatcacccaactgcctcaatggaggaaaaattgtgaggttaattaaaaataataatataaaaaggcaaccactgttaatattgaaaaatggcttgtcacacatggtgatcattctgaaaccacaaatgaccaaaactggtgaagtcctttctgtaacatcacaggcacgtctaagtgattcttttccatatctgtaaagtaactttacgaaagcaggtgaagacctgcccaggacctgaatgaaagcattcatgtatttagtcacaagagggggctgctgtgtctgtcaataagatgcctgttcagctggggaaagagtgtttggctcacagtcagtagtgaagccgtgcagaaactgtgacaaatgatactctttattctctttgttctaagcagagtagtctgtgcatagcttccaacattcaataattcctggccttgcctcaatccattatgaaaagttttgtttctactcaaaataggacaatatagaaagacagagacaggaagtagttatacagctttcaagttgaattgatcttttttttgtcgtttttgaaatagagaaaagtagatatttttggtggggaagatacttttttttctcaatctatttcatttctcttaaacttgagaagataatgagaaaaagtcttctaggttgctcccttccttcttacagtcccctcctttcttctgtctttcctcttctctgcatttcaattcttagtgtgtgtcaccactaggcacacacatggagaatggggaaaggtgggtcagggatagggtttctggggtgtaaggatgtgtgtgaccccaagtctcttgtttcctttgtaccaagatatgcagtctgtaaatgctctcctagagatagatgatatctagaggcatttcaggcatctggagacatggcttcctgatcaggttctgattatacttttctggtcactttggacacattactgtctgcgtctgagcctcatttcctctttattgttatttagatgggctttctccatcttcttatgatggtataagccttggtagggttttcctgaatataaagaaacttgtgacagagtggactgtactcctgggtaagagtttcaggcctaagaaaagatggtgttctaaaccaagaaatcagaagaggaacctgctgcctgcactgtcttactctccttcacccaagatgctaagggcaaccaatcaaataacagctgttaactttttgaggaggtcacatcctcagtgtgaggggctacatcatacccagtatattagtttgtgccataggctggggacttaaaaatcagaaatttattgtctcatggtctggaggcaatgtctgaagtcaagatgccaacagaatccaggaaaggaggatctgtttcaggcttctctcttcggcttatagatggccatcatatccctgtgtcttcatatcatcttccgtctgtgtatatctgtgtccaaatttctccttttatattgcattagatcccacctcattttacttagatacctctataatcaagaaataatcttgaacccaactccaaataaggtcacattctgaagtacttggcgctaggagttcaacatataaattttagagggacaaattttagcctataaccctcagtgaaagctcacagaagagttttctttgctgtagaatttcctgttttattgagcccaagggaaaatgacagacagatccagggagtcctgcctcttaactagtgagtctacatgaccccagccgtatttggctctttctaggggaagggagtcatacataaaattacttctcagtactataccaggggtcttcaacaagttcatgaaaaatgcatattacaaaaaaattatgcataatttttaaatttttgcatcaaaataaactcctactaacttgttatgacattgtacacagtatctaatttgaggcactaagaaggatgaaagacaaaacagtgtgaaaagagctcctgtcagagcaacgtgaattctgccaatattgaagcaaaaacaagcaccaaatttaaggtaaagcttgggtggaagaatggtgaaatcattgacaagtttatgggggcaattccccaaagaaattagcagtttacaaatgaataactcattttaagaagagacaagatgatgttgaaaatgaagcatgcagcagcagagcatacacattgattgagaggaaaaaattcatcttattcatgccctgattgaagaggactaatgattagcagcagaaaaaatagccaacaccatagacacctcaactggttcagcttacataattctgacttgaaaattaaagttgagcaaacctcccactcagtgggtgccaaaattgttgcacccatatcagctgcagagaaaagcagacatttcaatggaattttaaacaagtgggatcaagatcctaaagcattttttcaaaggattttaacagaaaatgaacacagattcaccagtacaatactgaatacaaagtactgtcaaagcaatgactgccaagaggtggaagtggtccagtcaaagcaaaagtggactggtcaagagcaaaggctgtagcaacaggtttttttgtttgtttgtttgttttttgttttgctcaaggattgttgcttgttgactttctggagagctgaagaatgacaacatctacttattactagagtgttttgagaaagttagccaaggctttagcagaaaaatgcccagaaaaagctcaccagagagttcttcaccacgacaatgttcctgctcattctttgtgagagtttcaatgggaaatcattaggcctccatctcacaatactgactttctttcttctgacttatttttgtttcctaatcttaaaaaaaatctttaatgggcacttactttttcttcaattaatatataaacaaacctgcattgacatggttaaattcctggactctcagttcttagggatggactaaatggctgatatcatcacttaaaaaagtgtcttgaatttgttggagcttatgttgagaaataaagtttatattttttaattgttaccttttaattccatatttctataaactttttgaaacccccttataccttgatctgaaaaatctgccttgatttgagggtctggggataatctcgtttttctcctcagggattatgtgtaatgttaaagccacaaaagtagggcagtgctgaaacaagaagtgaatataccctgttcccactctaccactggaggaaatgaggacacaatctggtatcaacagtttgataaccatggctcacagtatctgattggaggtttaaagaacgaggtgaccagtcaaatggcttcactgcctgtattagtctgttctttcattgctataaagaaatacttgagactgggtaatttgcaaaggaaagaggtttcattggctgttcaggttccgaaggttgtacaggaagcgtgttgttggtatctgtttggcttctggggaggcctcaggaaactctcaatcatggcagaaggtgaaggcagagccagcacttcacatggttggagtaggaggaagagagagaggacggggaaagtgccacacacttttaaatgaccagatctcaaaagaatgcactcaccatcacaagaacagcaccaaagggaaaatttacccccatgatccaaacacctcccaccaggtctgacctccaacattggggattacaatttgaaatgagatttgggtggggacacagatccaaaccatatcactgcccattcctgtggacaataaggctagtaccctggtcctgcaccagataaccctcaaaggcaccaccatgtgttactacactgtgggcagattggaccacatctgtctcccaggtgaagaggggagataaaatccatttaaagagggcattgcccaagaaaatgtgagattaatggaagaaggtagaaaatgaaatgagaagaaggaaaggggaaaaataaggaaaggtacatgaaatcaagaactgcaccagtaaagaaaaaacaaggagagagaagatcctggatattgctctttctccaatctaacattttcattcttggtaaaggtccggtgtcaagttcataaattgagcattatttttctgagaaatatctgggctctctcgattttttcaactatagcacatgcattgaaaagtaaatgaattttgaaaatttgctaacatgaaatcattatatcaatatttttatttcaacatttccctagttttctatgtacctgtattccatttttatgactaatcactttgtaaattaatgtgtaattgtttaagtatctacgcaatatagaataaaaagtgatacttcattgattttcttctgacaagttcctaatcactgttgggtttcatcacacttccactgtttctatacatttaaatacaaactcacagtaaacatacttttaaaaatcgtaaataggatcacactatatataaaatgctgtggttcaattgaataagagacagaagcttttgcaactcagaaagtttaacccaccttatacttttttgcaagtgtagtaagtaactcacaatacagagctaccataatgtattgactatctatattgaaagaatatttaaatttttttccacttttttaaccattgcatgcaatgtacagtgctgtaagtgtatttataagagtatttcttaagaaaaattcctggccaaatggaaattttgcattcagtaatatgtaaataacatatgtagacatttattaattatatttcagctatcagaatatcagagtatccatttcctgacattatcaacaaaactgaatattaatagtatgattctgaactccttttgcaatatgacaagtaagagatgatagaaagggccttttcacaaaaatgcaagttacgggaaaccagtccttaagcactgaagtggcaagaagagacagcagtcagaggaatctggagaaagttgctgtaacagtatggaaaacatttatatattttttcttttctaacataagcatttaagaatatatatttctctctatgcactgatttggctgcattctacaaatctcatattcaaacatttttgtttctttaggagaaggaggaggaggtgaaagtggaggagaaagaagcatttctctagcagtactgtgcttggttctgaagtggcagtgttttcatttctttcattccatttccacctcccacattttgcagatctgtgtgtgtgtgtgagagagagagagagagagaggagagagagaggagagagagagagagagagagagagagagagagagagagacttgtctcagattggctgggccaactctgtgtttcctgtagaaatgtttgaacatatgagagagcaaagcagagtgtttatcttgtgagccattctccatatttcagatataagatttcagttctcagtgagtctaagtgacagaaggaatggagaccctcttgggcctgcttatcctttggctgcagctgcaatgtgagttagagggaaatggaaatgagcaaagagcaggctgactccaggacgtttctcccaggaaagagggagaaagaaagggagttgttatgcctgtatggtttactgggaatttctgtggaaattgaaaaaataaatttaaaggtaatttctaaggaatcattagccactaaccagtctattgctctttttctgaacaggggtgagcagcaaacaggaggtgacgcagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtgaggcacagtgcacaacaggcacctgcaaccaatacccaaactctatagctggggctctaactgcatgttttatcttgagactgagcaatgtttttgcattaagaggacttctaaattgacactgtctccacacagaagcaatcaaatacacaaaacttgatgtaataatctgaaattaaactatgaattctctgatctttagatttttatcaattttaatataaataatagttttatttcaattaatttacatgccatgaagttcagtcttttaaagtgaacaattaagtgttatttagtgtattcacaatgttgtgcagcttttatctctgtgtagtttcaaaaactttttaacatctcaaaaggaaaccacatgtccattaagcagttaccttgcccaccctcctcccagcctctggcagccaccaacctgttttcagtctctatggattttcctattctgtacatttcatataaatggaataatatagtaggtagtggcctttgtgtatggcttctctcacatggcataattttctgaggtttattcaatgtaggaaggaccagagaaagctaaatatgcacatctaaccaatgacatgcttatatcttccccatgcaagagcctccaaccagggcatacctgaagctttgttagttttcttccactctaaagcttccctactcctctgcctatctttaagtctctgccaaacacaagggacggtagctgattcctttggtataccaagctctgaataaattgcctttgcttttttcatttaggtggtcttcacttatatccacagaactattgtaaagacactgagtttttcttccctgccaagttctcacttcaccataagagtcactttgcacatgaaaaattaatgaatcaccataagaaatgttaaagctggagggcagcttgtcctccattcagataggtcattgaagcctacatcaatcagatagtacttcttagataagtcagagagatgcattgatgtaaagcccagttctcaatatttacgtgtcaaactctgtcctcaataaaagctcgaaactccaaacagatatcttggccttcctggaagattttcttatcaacaagtccttgttctcatttatttcttttactaaatattcaggctccatattgtgtgatgaggagtttgcattcacaacctctgccatatctgggctacaaagctgctttctttcttgacattacaaaccaactcgtgggtaagtaatacattcagatatatgagctataaaggagcttaaatagtgggggacttcaccaccccactgactatgttaggaagatcatcagggcagaaaactaacaaagaaattctggacttagggccgagcgtggtggctcaagcctgtaatctcagcactttgggaggccaaggcgggcggatcatgagatcaggagattgagaccatccttgcaaacatggtgaaaccctgtctctactaaaatacaaaaaaattagccaggcgtggtggtgtgtgcccgtagtcccagctacctgggaggctgaggcaggggaatcacttgaacttgggagacagagattgcagtgagcggagattgcagtgagccgagattgcgccactgcactccatcttggtgacagagttagactccatctcaaaaaaaaaaaagaaaaaaagaaattctgcacttaaacttgaccaattggatctgacagaattttatagaatacttcagtcatcaaccacagaatatatattcttctcattggccataaagcaagcctcaataaatttttttaaaaattgaaattataccaaccatactcttagacaacagtgaaataaaaatggaaatcaatactaaggagatctctcaaaatcacataattacatggaaattaaacaacttgctcatggatgattttagataaaccatgaaattaaagcagacatcaaaaaattatttaaaataaatgaaaacagagacacaacatacaaaaatctctgggatgcagcaaaatcagtgataagaggaaagtttatagtgctaaatgccaacgtcagaaaataagaacgatcttaaattaataatctaacatcatatgtagagaaacaagaaaaaggacaaactaactccaaagctagtaaaagaaaagaaataactaaaatcagagcagaactaaatcaagacacaaaaatccatacaaagcataaataaaaccaaaagttggttctttgaaaaaaaataataaacaagatgtatagactgctagctaaattaactttgaaaaaaataataaacaagatgtatagactgctagctaaattaacaaagaaaaaaagagaagttccagataagcacaatgaaaaatgacaaaggcagcattacaaatgataccacagaaataaaaagatcctcagaaactattataaacacttctatgcacataaactagaaaatctagagaaagtggttgaattcctggaagcacacaatcttccaagattcaatcaagaaaaaaattgaatcagtcattaagaatctagcaaccaaaaaaacctcctgggccagaaggattcacggccaaattgtaccacatggacaaagaagagcttgtaccaatcctgctgaaattattccaaaatattgaggaggacggacaccttcctaactcatgctataaagccagcctcaccctgaaacaaaaacatggtaaagacacaaagaaaaaagaaaactacaggccaatattcctcatgaatctagatgtgaaaattctcaacaaaatactagcaaaccgaaaccagtactacttcaaaaagttaattcaccagaatcaaataggtttcattcttgggatgcaagttttgttcaatatatgcaaatcaataatatgattcaccacataaacataattaaaaacaaaagccataagatcatctcaatagacatggaaaaaacttttgataaaatccaacatcccttcataataaaaacctttaacaaattaggcactgaagaaacatacctcaaattaataacagccatctatgacaaacccacaggcaacatcatattgaacaggtaaaaactgaaaacattcctcttgagaactggaacaggaaaacagtgaccctcttaccactcctagtcaacatagtattggaagtcctagccacagcattcaggcaagagaaaaaataaaagactttgaagtaagaaaaaaggaagtaaaagtatctctctttactgacaatatgattctatgcctagaaaatcctaaagactctgccaaaaactctgccagaagacccctggaactgatcaatctttcacttccttggttagatggattcctgggtatttaatttttttgtggctatggtaaatggtatgagagtgaaagatctctacaaggataactacaaaacactgctgaaagaaatcagagtcaacacaaataaatgaaaagccattccatgctcatgaattgaaagaatcaatattgttaaaatggcaatactgccaaaagcagtctagagattcaaaactatccctatcaaactcccatcattatttttcacatgattagacaaaactattctaaaattcatatggaaccaaaaaagagcccaaattaccaaagcaaaaagaacaaagacagaggcatcacattactcaacttcaaattacactataatgctacagtaaccaaaatgataatggtagcagtacaaaaacagacagatagaccaacggaacagactagagaactgagaaagaaagccatacacctacaatcatctaatcctccacaaagccaaggaaaacaagcaatggggaaaggattccctattcaataaataaacagaattaaaaacaaaagatttacagtaagacctcaaactatcaaaatttcagaataaaacctaggaaatacccttcttgatatcagtcttggcaaaggatttttggcttaagttcccaaaagcaattgcaacaaaaataaaaattgacaagagggatctaaataaggagcttttgcctagcagaagaaactatcaacagagtaaacagacaacctacagaatgtgagataatatttgcacactacacatccaacaaaggtcttatatccagaatctataaggaacttaaacaagtcaataagaacaacacaaataactgcattaaaatatggacaaaggacaagaacagacacttctcaaaagaagatacagccaagtggccgacaaatgtatgaaaacaattctcatcatcgctaatcatcagaggaatgcaaatcaaaaccacgatgagataccatctcacaccagtcagaatggctattattaaaaagtcaaaaaataacagatgctggctaggctatgggaaaaaaggaacacatactctgttgatggggatgtaaattagttcagccactgtgaacagtttgcagagcagtttggaaatttctcaaaaaacttaacttaaaatagatctaccactcaacccagcaatcccattactaggtatatatccaaagaaaaataaatcattataccaaaaagacacatgtactcgcatgttcattgcagtgctattcacaattgcaaggacatggaatcaacctaggtacctgtcaaatgtggattgaataaagaaaatatggcacatatacaccatggaatactatgcagcgacataaaagaatgagctcgtggcatttgcagcaacatggatgcacctagaggccaaatttctaagtgaattagtgcagaaacaggaaaaccaaataccacgttttctcacttgtaagtgggagctaagcattgggtacacaaggacacaaaactgggaacaatagatactggggtttcctgacaagggtaggactgaaaaactacctattggatactatgctcactacctgagtgacaggatcattcataccccatacctcagtgtcacgcaatatacccatgtaacagacttgcacataaaccctcaaacctaaaataaaagttgaaattgtaaaaaaattaaaaataaaattggatatagttatgaaaaagggggcttgactagtgctactttaatagctattatattccataatataaatgaacttctattgttaatgacaattaatgaactacattgcaagaataaatgtgagagttcacatttgaaagaagttgaaagaagttactttctcctgcacatggggtaacagcatcttaggtaggcaaacactttgctgttggcaatatggcagtgaacagttacaatttaacagggaagatgtatacacacaacaaagcaattcaaacaaatatataatttcaatgcatgataaggacaataaattttaaaaatggatatgaaagatgataaaattgtgtttactttggcacggtggggattatgctgctggtggtcagagaaggcctctctgagaaaatagttacattgagatatgtaggaaagattgcaatagcaaagttaaggttcctgctaaaaagagctgcaggcagagagaaccacttgtacgatacagtgaacttaatcaataaatcttttgtgtgtgttctgacttctccaccaagtgaccgtttgcccctctctttctctctctgcaggcctttctatcccctaagacataacaatattgaaaattggctaacagtgacttctaactgttcaagggaaaggaagagtcgcatatttctcacattatttatttttctttttgtggagatggggtctcactatgttgcccaggctggtctcaaactcctgggctcaagcaattctcctgcctttgcctcccaaacagctgggattataggtatgaaccaccacgatgggactctcattttaagtcaaaagctagaaatgattaagcttagtgagaaaagcatgtcaaaagcccaatcaataagctgacagatagacctcttgaactaaacagccaagttgtgaatgcaaaggaaaatttattgaagaaaattaaaagtgctactccagttaaacacataaatgataagaaagtaaaacagccttactgctgatatggcaaaagttttagtgttctggataaaatatcaaaccagttacaatattcccttaagccaaagcctaacgcacagcaaggccctaactctcttcaattctgtgaagcctgatagaggtgaggaagctgccaaaggaaagtttgaagctacaagaggttgtttcctgaggtttaagaaatgaagtcatcatcatgacataaaagtgcaaggcgaagcaggaagtgctgatgtagaagctgcagcgagtttccagaagatctaactaagaccactgatgaaggtggctacactaaacaacagattttcattgtagacaaaacagctttctattggaagaagatgccacgtaggactttcatagctagagagaggaagtcaatgcctgacttcaaaacttcaaaggacaggctgattctcttgttaggtgctaatgcagctgatgactttaagttaaagccaatgctcatttaccattctgaaaattctagggcccttaagaattatgctaagtgtactctgcctgtgctctataaatggaacaacaaaacctggatgacagcacatctgtttatagcatgttttactgaatattttaagcccaatgttgagatctactgctcaggaaaaaaaaggttcctttcaaaatagtactgctgattaacaatgcacttggtcacccaagagttctgatggagatgtacaaggggattaatgttttcttgcctgtgaatgtaacatccattctgcagcccatggatcaaggaataattttggctttcaagtcttactatttaagaaatacattttacaaggccataactgccatagatagtaattcctctgatggtctcagcaaagtaaattgaaaatcttctacatgataccattaagaacatttgtaactcatggaagtaggtcaaaatatcaagattaacaagattttggaagaaagtgattccaacactcgatgactttgaaaggttcaagacttcagtggagtaagtaactgcaggagtaaatactttagtggaataagtaactgagataattttgaaatgatattgatggttcttgtatattttaactatctaggacactgctgtagaaagcttttaagaatgggagggaaatcatgggtttggcatggttaagttgttttctttcctggaggcagtaaacgagttgaaaggctcttgaggtgccctctggagctcagaatttttaaatgccagttttaaaagatccaaatgattatcaaaatatagtggtagatagcaggagaactagaattagaagtggaacctgaagatgtgattgaattgcttcaatctcatgataaaactaacaaataaggagtttctttttatgggtgagcaaacaaagtagtttcttgagatggaatctattcctggtgaagatgctgtgaacatcgttaagataacaacaaaggatttagaatattttataaacttagttgataaacccatagcagggttttagaggcttgacacagattttgaaagaagttctactatgggtaaaatgccatcaaacagtattgcaggttacagagaaatctttcatgaaaggaagtattaattgacgcagcaaactgcattgttgtcttattttaagaaattgctatagtcaccccaaccttcagcaatcacatcctgatcagtcagcatccatcaacatcaaggcaagaccctccaccaacaaaaagattatgacttgctgaagaatcagatgatcgttagcattttttagtaataaagtacattttaattaatgtatgtacattgtttttcacagtgctattattgtccacttaatagactacggtgtagtgtaaacatagtttttataagcactgagaaaccaaaaagtttgcatgactcaccttattatggtggtctataatcagcaatatttcagaggtatgactgtatttgactttgccatcaactcaatgacttacactccagaaattgttattagcagaagcataccaaaggtcaggcaatgggagtggtttgtcccagttgcaggtaataacagggtgctttatagagagctttttaaaaacaatataaaaatgattaatagccaatctgatttttattaccgtatgccaggaattctaaacaatgtcaatgataaaaaatattttttgacctaagttctaaacaaatgcagaggttactatttattttaataataaatgtatgcttcaaattatcacatttttatttcttatcatgtaataaacagttttctacatggaagttattttggagaattctcagttttgcagctgtcttcaacacacatggattgtaatacagcgattttccatgtaccttttatccagtttcctctaataatatattatctttgatatgttgtatatatatcaaaacaatgatataattacagccagaatatggatgtcgatatagtcaagatacagaacatttccatctctacaagcatcctcatgtttcccttttattagcaatagcaacttccattatgccaccatctactatttaacccctggcaaccactaatttgttctccatttccataattttatcaagaatgctatataaatggaatcattcaggatatttatgaacatgaatatttttcactctgcataattatctggagattcatacaggtcgttgtatatattaatgtttcattccttttcattgctgagtagaatttcatagcatggatatgccagtttgtgtaaacattcacttaatgaaggacatttgggttgtttccagttttgagctattatgattaaagcttctataagtgttcatgttcaggtttttgtatgaaggtgagtcttcgtactctggaatatataccaagtagtacaattactgagacatggagtaagtgtatgtttagttttataagaaatcgccaaagtattttctaggttgctgtactgtcttgcattcccaccagcagtgtttgagtaatctaatttctccacatttctgctagcattttgtgttgtcattggttaatacttcagcaactctaagaggtatggagaaatcattgtagttttactttgcatatttctaatagccagtgatgttaaacatttttggtttttctttcttttttaaattaactaaagcccacactttattcctatttcctttgtttttgccaaatgtcctttttatgtctgcagggtctgtaataacactccctgtttcattcctaatattagtaatttgccttttttttctttgttttactacaagtttgtcagttttacccatctttttaaaaacggctgtttaatttttgtttctgttttcagttctattgatttctgcttttatcttgattaattccttccttaaatttgctttggattaattttttccttctttttcttggttcttgaggtgggaacttagatttttgtttggatacttttttcatttttaatatttgcatttagggatatacattttctctcaatgctgctttgactatgtcctacaaattttggcatgttgtattttcatttccactcggttcagtgtatgattgatttcccttgagcttctttgatccttggattattaggatgtatgttgtttaattttcaaatatttggagatttttctgctctctttctgatatttacttatagttgtattctattgtggttataaaacatagtctttattgtttcaattcttttacatttaattttttgaggtttgtcttgtggcctaagatatggcatacttggtatacgttctacaggcatttgaaaagattgtttattctgccattggtaggtgccatgttctagaaatggctattagatcctgttggctagcagagttgttgagttcgtctatgtccttgctaattttctggcaagctcttctattagttattgagagtggggtgttgaagtttccaactataattctagaatcatcggtttcttctttcattactatgagtttttcttccatgtatttttcagctcttttggttggtgtatacacatttagcattgctattccttcttgaaagactgaccctttcaacaatatataatgttcctttctgtctcttctgtctctggtactttgctttgctcagaagtctactttacctgatatcgatataattattttgactttcctttgattaatgtttgcacgatatatattttactttctttctttctttcttttttttttttttttttgagacggagtcttgctcagtcgcccaggctggagtgcagtggcgcaatcttggctcactgcaggctccgcctcccgggttcacgccattttcctgcctcagcctcccaagtagctgggactacaggcgtccgcgaccacgcccggctaattttttgtatttttagtagagacggggtttcaccgtgttagctaggatggtctcaatctcctaacctcatgatccaccagccttggcctcccaaagtgatgggattacaggcgtgagccaccgcacctggcctatattttactttcaacatgcctatgtcattaagttagaaatgaggtcttcgtagacagctgtagttggatcatatttccactcttttcactttctctgtattttaactctcttttcattgctgtttgtagaccaatctctgtatcttaattggtatatgtacatcatttgcatttaatgtaatgtatattttagtgattaatcttccatttaattttgtttgttctgttttttgtttccctgtgttttatctcctaacttcttgtgaattatttgacattttctaaaattccattcaatttacctataatgccttggatgtgtatttttgtgtagctttcttcagtgtttgctctaatggctattataaatagataacacagttgtctattggtgatgtcattccaccaatttaaatgaagtataaaaacattgtctccctttacattcagttgtcctcaccaattcatgatacagttttctttatgttttccccaatatatatttagaacctcatcagacagtgttattatttttgcttgatccatcaaccataactgtgaattaaaaaaattgatcaaacatgtttggagtaaagacttcattatcttattttctctatataggaaatattacaaatttattgtcatatgaagtcaattaagaagtatggaaccaaaaaatataaaaacaaaaaatcttaattctggcaaggacgtggagaaaagggaactcttgtacactgttagtaggagtgtaaattagtataaccactatggagaacagtatggagtttcctcaaaaaactaaaacctgagctaccataagatccagcaattccactgctgggtatatatccagaagaaaggaaatcagtatattgaagaggtatccgcactcctgtttgttgcagcactgtttacaacagctaagatttggaagcaatctaagtgtccatcaatacatgaatgaataaataaaatgtggtacatatacacaatggagtattattcagccataaaaaacaatgagatcctgtcatttgcaagaacatagacagaattggagctcattatgttaagtgacataagccaggcacagaaagacaaacattgcatgttctcatttatttgtgggatctgaaaatcaaaacaattgaactcatggacatagagagtagaaggatggttaccagaggctgggaagagtagtgagggaatgaggggggaggtggggatggttaatgagtacaaaaatatagaaagaatgagtaagacctactatttgatagcacaacagggtgactatagtcaaaagtaatttaattgtgaattttgaaataatgtacagttaaactaagagtgtaattggattgtttgtaacacaaaggacaagtgcttaaggagatgaataccccattctccatgatgtgattatttcacattgcatgcctgtatcaaaacgactcgtgtacccctaaaatatatacaactactatgtacccacaaaaattgaaaatttaaaaataaagtattatagaagtgtgtcagataaacaaggaaatatgtaaatttctgaattctgtatttatggtattcgtgttttaaaatttatagtttgttgtgattttctgacctaaaattatttttgtacccagttttattcttatttttatgttattctttttaaaatcctccatcttgtaagtttcaggcttacaaacataaatcctcctttgtacattatcataaatctttgaaattcaacactagaagggcaggaaggatgtggaggaagttcacaaaaattgtgaatttctcttagccctctatttggcccctggagggtgttgttgcctaaattggaaatggcttttctttaaaagattagaataagctccttccttctctacaggttaaagaggtgtcctttctgactgagcattcttttagacagcgatgtataaagaatctcagacaccagaggcaggcaagtttgtcaagagagcatctcttactagcagtttctacaagatccctaagaagaagaaatctaaatccctgccatttctccttagtttcaacctggattcaagttaccccgtggtcagattgtgtctgtggggaatctcctggaaaggtgcatgctgctccctcagtgcttggctagatctcattgtgtgtcttgacgcttggggtactcctgttcccaagtgggtatcattccattttactctcttgtccacaaatggagcattgtctatttgactctgaatacggactttttgtgttagctgagttcactgacatagcattggcattgtaggaaaaaccactgcccattctgtgactcagcctgacgttcatgtcgctgtctctgaaggagcccctctggagctgaggtgtaactattattgatcttctgttccaacatatattttctgatatgtgcaatacctcagccaaggactccagcttctcctgaagtacctatcaggatatagggttctttcaggaattaacggttttgaggctgaatttaagaagaatgaaaactgcttcctcctgaggaaaccctcagcctattggaacgacacgctgagtacttctgtgctgagtcccgcattgcccaggactgtagtgggggctacataaaaactacctgagacacatagcttaaacaactaaggatctcagcctcagttattttcaggaagttgacgtgttctgtgaaagcaaacagtacaaagaaagtagaatcctgtctagcatttagttcctatggacatcttagatttctttaatttattttcttatttgccattttgcaaaggaaagagcttgtacctgattctagaagaaattagactataggatttgtaacaagcaggaggaggtgatttgcaccaaggtatttcagatagtgatggactgggatgacttaaggttggccatgtggattggtataaggcaaatcaatttgcttttagttattaatctcatctctcaaacaatcagaaacccagaatgagtgtttatttcaagctgcattatctacagattattttacccagtatcctgacttcagtgagctacagtcctttgaggaaagaagcctcttcaaaggacttcagctcactgatgaaagtatttgagactgggagacttaattaaagctgacatttaaggatgtgtgcaaggcaatctttccaaagacaatataaaagggaaaaaaaaggctttatttttttaatctggtggtccccagcgaaaggcagtctaaattaaacacaacatcatggcagagttccatgtggaatcttggggttggttgttctatggatgacctaccctttatcagttctacccagattacctctctctgtttttctccctttcaattcaatttccctaatacttgctgagtgtccaataactattgttgattccttaaccatatttaattatttctctacaccattcctcatagtgccaatagtaactatttgcaacgttcttgagcagttaatccaatgttgtgcctgcagaacttttatttctacttcagtaaaaatataggtgttcttatttttcaccccctttacctccaaatccatttccagattattattatttatggagtctggggcaaaagcaaaaacaaattattttcataacttttaaaaacagctaattttcttttaaaccattagaataatctagtaaacctaaaaagcaaaatataaataataattaacaatgaatagctttaataaaatatatttaaataaaattagaatttatttgtttttaagtttaattcgatcacagtatttaaaataaatgctagtttcaacattcatctagtatataaagaagctaatcagtgtcactctttatgcagattcaatctaggataaaatatatgcaatttaaaactaatgttgttgaatattacaaagtgttccagccatcatgagcaactatagtgaatactatgctgattcatgagtaccctgaagaaccacaaatgagtacataagagatgcaagaaaatagatcctcagcaccctcgggaaacagtatttctttttgtaagaatctattgcctccgtgctgagaggaaagatggggctagctaattaattttttccttcccttccttgaaacccctccacccttggccccaattccaaatcagagtcatatgaagtcaattaagaagtatggaaccaaaaaatataaaaacaaaaagtgttaatgctggcaaggacatggacaaaagggaacccttgtacactgttggtaggagtgtaaattagtatagccactatgaagaacagtatggaggttcttccaaaacctaaaacctgagctactataagatcatatttacttatttttctacaccattcctcacagtgccaatagtaactatttggaacgttcttgagcagttaatccaatgttgtgcctgcagaactttaatttctacttcagtgaaaatataggtgttctcatttttcatcccctttacctccaaatccatctacagataattattattattgatggagtctgggggaaaagcataaacaaattattttcgtataaacagagtctgcctcctatggcagcagtggcacaacccacaaatatttctaatatttgaaaaggacaaaggtcaaggtatgtgaagaagtatttttctcaaatctgaaaaattgtgttagtggttttttaggttacagattgtgcccggtcctgagtgacagagacagtccgtgttcttcagtacatttgcgtgtgtgtgtgtgtctgtgtgattgagtggccctgtaaaatatgaggctctgggcagggctcttgcctgagtctaagggtcatactgtccacaaccttgctcatcttctgtccttcttgtatttaaaacaaagggtcacttttcaaagtttgccatctttgcttttgttactctccagtctcgtcacctccacagaaggcatgtagcatcacatcccccatcaagtcacatcctgtaatagaagtttgacataattgttactgtcttggtgctcatgtggtgtttaaggatgctttttaaaaatgatatcctgtaaacctttattacattcagagagatgtttgtctcctcactatatcacaagctctctgaaggaaaaaccgtatccaattcatttttttttttaatttccaaggtctcaaacactcttaaatatattgacttaactataactgaatcaaattggtgagctcatattttttcagttcatacgtatgaattaaatggatgttctaattacataaaattacatttaaagtatttatcttcataaaagccaccgtggggtctcatggccctatttatggtactctccattctgtggacacttctgttgtttcatgtcaacccacaggtacagccctaggaaaagacagctgggctgagctgtccatatatgctgaggaagatgtagtctttctcaaggtttagcacgtcaggaggcatataggcttctcttaaattgagggacggctctgaaggatctagtagtgaatagttgttgaaagatttgagaaatatattgagtataaggatgagggccagtaagagtaaagagggaagaataattatgtgcaaggacaaactaaatcattatcagcacataagaaacatatttttgctgagtattcttttcaattgtagctctgtcctctaaaacaagataaatgacatatgaatattcaagttctaggttatatttgaaatgcatatatatatacctatatttaaatttttgtctttatattattatctttatctgtatctatcagaaaatcctggatcaaacagaatcatatacagcaaaagggaaagtggagaattccaaagaagggaattcggattttaaaaaatttttatttcctaagatttcctaagaaaaaaatatgaacttttatttcacaggtccaaaattatttctaaactgttgaaagccatcttttctttagtattcttctgtccctttcatgtaactagaaccccctaccctcaaccaaaaataaataaataaatagataaataaataagtaaataaataaaagagagagagagaaaaggaagaacatggaaacagaaggtaatgataggagaaagtggaaggaaaaaaggaagacagaaaaaaaaagaaaaaagatttactggactgtaagataagctataaaggaagtttgtataaaataagaattagaaaaataaaacatattgcccatccagggtaatacgtagaaaaaaatttgaattgatcttattttttctctcacaatttacagtcttactagggtcatttcttataacaatatttaccacaattcttgattatttcagaggagtcctaatccacacttttcatatattctaataataaaaattattacatatataatacataacatgtatgttcttattactttacatgactggaatgactttcacctaaattggctaataaagaccttcttgtcagaacacattcttgttttgggggtttaaaatgtggacactcattctgtgatcctctccaggctcgaattagtattacagttgaggcacgttgtcctcccgaggaggcccctccctttccttctcacaggatctttcacattctttactatatccagaattattagaaaacatccctcaggttacggaataatgacctttctttttcccttccactccacccctttccaccccggctctcagccaggtttaagtcggcgggtggggcttcctgtcacagaacgctgtttaaaaactcagtagcatctgggcgtgagcaggctttgtcgggtggagctgattggttgcaggagcagcaacagttccagagccaagtcatgacaccgacctccccaaggtttagttaaatatatcttatggtgaaaatgcccggagcaagaaggcaaagcatcatgaagaggatattgggagctctgctggggctcttgagtgcccaggtttgctgtgagttggggctgtccaaggtgggaatctgaaaggatttagcagctgcagccttgttgaggggaggaagggcaaggagttaaaaagtcatgcagtctttctattcacacaacctgtgggggcattttcaggattcttcagatgttaaactgcccatcacctatgactttttctccatttctgaccaggtgtgagaggaatacaagtggagcagagtcctccagacctgattctccaggagggagccaattccacgctgcggtgcaatttttctgactctgtgaacaatttgcagtggtttcatcaaaacccttggggacagctcatcaacctgttttacattccctcagggacaaaacagaatggaagattaagcgccacgactgtcgctacggaacgctacagcttattgtacatttcctcttcccagaccacagactcaggcgtttatttctgtgctgtggagccacagtgctccccaggcacctgcggcctgtacacaaaccctcatccgggctcggttcctctaccagtaacaaccacatcacgaggccaccgcagcagcattttgcacagcttaatattccttttgtacataggtagagttttaaccgtagattctttttggctctacaggtttgagactttggtctttattttcccttttcaatacacacctcctcctaccctataaatatctaacttggaaggagtagagtagctgataagaggacagaatcaaaataaatatttaagtgacagtatgcaggactccaaaagggtaaaaagtaaaaagaataaaaagaaaagaaacaccattccaataagcatgttgttagacattagttagacagtgatccagcttagttgtgtgtctcaagcacattcaggtctacctcaccacattatgtaccaacagacaagggcaaatatttgcatactatcccactagtgcagcaaagtaaaatttctttaaatattcacatattgataaatagctgtggagaaaaaactttaaaatgttatgttcccatatgtgtttttcaggcttgttgtataacctagaatatgatctatcctggaaaatataaccatgcatgattgagaagaatgtgtaatctgatcttgggtagatagatgtctgttaggtctacctggcttttgtgttgttcaagtcttctatttccttgttggtattctatttgtcctatctattattgaaagtgaggtattgagtcttcacctgttattcttgaattttctgtttttcccttcaattctgtcagtttttgtgcatcatgtattttgggatatgtcattaggtgcatatatgtttataactgatatattcttaatggatgcccttttatcattataaaatttccctttttatctctagtaacattttttggtttaaagtatactttgtctaataataatgtagtgactccagtcatatcttttcctatccttttactttcaacttatttgtatctttgtatctaaagtgtgtctctgacagtgtatagttgtgtgtgtgtgtgtgtgtgtgtgtgtgtgtagccattctgataatctctactttttgattggattgtttaatccattaacatttaatgttatcattgatatagattatatctggcattttaattttattttctttctgtcttatgtcttttttgttcctctgtacctccttaactgctttcctttgcattaggtgaatattttatagtataatattttcattcctttatttttttcactatgctttttcaattattttcttggtggatgttttagtacttacaatatatatacatctaaacttgtcagaattcacttcagactttatgctaacttaactccaatgggattttcagatgtcacttctatataggtctatttcttattccctttattattgttattcacattatatgtatatatgttacaaacaataggttattataatttttatataattttataattatttctttatataatcttatgttttataagctgagaaggaaaaaaggaaagcaaatatatattgaagtgtttgttgttaaccttcttacttatcatttctgggtctcttcatttgttcctgtgcacttaatcatagccaaaaggtcaagaagtgatcatttgttcctgtggattcaagttgccatctggtgtcactgtcttactccaatatagttttgcaatctgccttcctcctttattcttttattatcaaatatgttacattcctgtaagtccaataatataattatatatgtattgttttatacagtagttatttaaatcagttaatagtagaaaggggataaatatgcagtcacactatctttttagtaagtgtgtggatgcaaattactgtttgaagtcccttgctcccagcctgaagatcttcctttattattgcttgaaggtgagtctgcttgcaataaattctctcagtttgtatttatctaggaatgtctttattttaccttcatgtctgaaagatacttttgctgaatataggatcttcattgatggtatatttctttcagcactttgaatatatcttcccactgccttctagctctgttgtttttgttgagaagtcagctgttaattttattgagtttctctcataaatatttgattttctctttctactttgaagattctatttgtcttttaacatttttgctatgatgtgtctgagtgtggatctctttgcattcattttacttagagttcactgagcttcttagatgagtagattaatgcttttttgaatctgggaattctcagccattgtttcttcaaatttttttgttcctttttcttcctttcctttttctggtactctcactatgcgtatattggtgtgcttaatgatgtaccacgtttctctgagtccctgtttatttttctttattcttttttctgtctgtttttcagattgcataatctctgtagatgtatctttaagttcactgattccttgttcagggagcccgaacctactgtttgaccctccagtcaatttttttatttggttattgcactttcccaactctagaatttctattttgttcctttcataaaaaaataatttttaccactttatagatattctctggctgataagaagtcatcatcatatcttttttacttccctcagcatggttttatttctttgagcatacttaaaacagctattttgaaatttttgtctgtgaaatccaacatctaagtcatagaaaaggaagttgccattacccaatttatttctcttgtgtaagaatcacactttcctgtttggggtatatcttataattttttgttttaaactagacattttagataacatattatattagttttctatggctgctcttatgggttgaattgtgtttctcaaaattcaagatgaaatcctaactcccagtacctcagaatgtgaccttatttgaaaatagggtcattgcagatgtaattagttaagataaagtcataagaatggaccctaattgtgatggttaatgttaggtgttatgttgattggactgaaggatgcctggataactggtagagcattgtttctgggtgtgtctgtgatggtgttgccagaggagattgacatttcagtcagtgaactgggagaggaagacccacactctttgtgggtgggcaccatccaataggctgcgcagctacaacaaagcaggtgaaagaaggtgggaggcttctggctgcctactttctcccatactggaggcttccttctgcttctcttgtccttgcgttcctggaccaaactgaggtttgggctgctatttttttacagacaaataacgagatgcagatgaactggggaggaagagagtttttatttctgtagtcagttacagggacatggcccggaaattattgccagactaactcaaaattacaaagttttttcagagttttatataccttctaagttatatgtctacatgtaagtgtgcattcatttaaagacataaatgattaacttcttttaatttataactaaggtctgagtcctgaagaccttcttctagagtctcagtaagtttatttaacctaaatgggtttaggtgctggggtgattagccttatctggtcttctgccaaatcacagaggtttggggagttccttcagacctccaataaatgtgtttgtggaggcctagcgagtttcttcagaccccctataaaacttgtttaatcctaaagaggccctgttaagaattactcctttattttgtcatgcttaaaagcccaggaaagtcccaggcaaaactcttggtgggcttttgctacattccagcctttgtataagggcactggcttttaatatttatcttaaccactcagtcagtaccgaaacagttgttatggagtcctgccacacttggacatcagactccaggttctttggcctgtggactctgggacttgcaccagtggcttgcaggtggctctcatgcccttggccgtagacagaatgcttcactgctggcttctttggtttgaggctttcgagcttggactgaaccactaccagcttctcttttccccagcttgcagatggcctatcatgggacttggccttgtaactgtgtgagccaattctccataataaataaataaataaataaagtttattagggagaattggcacacacaattacaaggccaggttttatatatatatatgtgtgtgtgtgtgtgtgtgtgtgtgtgtgtatgtacatacatgtatacacacacatacacacacacacacacatacacatatatcctattagttctggagaaccctgaccaatacactaatctaatatgactggtgtcctcataaaaagtgaaagtttggaaacacacacacacagagggagaataccatttaaagatgaaggcagagatcagggtggtactccaacaagccaaagaatgctaaagattgccagaaaaccacgagaagctgggcaagaggaatggagtagattctcgtagccctcacagggagtctctcagacttccattctccagaaatgtgaaacagtaagttcctattgtttaagtcacctagcttgtggtactttgttatagctctagcaaactaataaagctgctataacaaattactgcaaatttggtagcttaaaaccaaacaaatttattctgttacagttctggaagcaagaatctgaaaccagttttacagggctacagtcaaagtgttggcagggctgatttcttctggaggctctcagggagaatctgcttcctggccttttccagcttctgctgtccacctgaattcatggctcatgctcttttttgaatcactctaaacttttgcttccatcatcacatctcctttctcttctggagccacatcttcccctgtttccctcttataagagcacttgtgattatatttagggtccactcaaataatccaaaatatttttcccatctcaagatccttaataatgtattcaaagacatttttgccatataaggtaccatttgcaggtaccaggcattagggcttggttatctttggggatgataatccaggctatcacatatagtgactctggatattgtgtctctaccccatccagggcttgttgttatttgcttgtttatttattgtaacaactttacttgactatttcagttaagtccattttcctgcagggtgcagcctatgatgttattcctcagaggacagtctttggtatgtgcacagacatcttgatatgacggtggtttcagcagtgttttctttaactgtctttcttcctgatttttctgttaaactacctgcatctgtttgtatcacacttagccatgagcctccacacttatccatagtctggttcaattaaattcaggcccctttgcagaggtaatctttgaggtcaatctttgaagcttcttataacctcaggaggactcttcccagctgtctttattcccggttctctctattagatttttagctagtcatctgtggtttagtttgttgctctcgtggagctaccagcctcctcttaattgcttaccacaaaaatcttcattcatttccactgtacccttaaggcttggacttcctgaagctctgttccaaatagagtcttcctagtggagagctctctgttcttataactcctcctctccctgggcacaacttctgtgcccctgctctggagcaatgtgagaagagacattgcttttctttcctcagagtgataaccctactttaggagcaaggtgcttgatgggggcagtatcccatggtcttcttgtttgcctcccccggtatgaaacctccaccttatgagcaagctggggtgagggaaataaggacccagtattcttggtctgccatgccagggtagagcttctgccctaacagtaggtgctaggaagtgaaaaggagccctaggcctttcagcttccctggcccagaataggacttctgcaatacaaaattgaggaagatgagaattgttggcagactgtccctcccaggcagatatcgtagctcaacactggaatctgagggaagaaggagccctgtattcttggttgctcccacccgaagtagagtttctattatgctgagctctgtgtggtgggggaagtagtagtcatggctcaaattccaaggattttgttcttatggtgatttagtaaattttcctgaatagataattctccatttgctatatacccaggacaatttccagagacttaagtttttaaaataatttttaccaattaatagtgttttgttactaattagggagagtaaccatgaacctcctcatattgcaattctgaaagtcacagcctcccattcatgatgttatcacatagaacaggcctaaacagaagataatcagaagttcaacttttctttgactttctccattgagaaataaaggtgaagctgccatcttgttttgatcctaaacctgccacagagataattattcaaacacgtcatgtatcaccatcataaaataagcatgtattctgagagtattaaagatgaaaaacaggaacactatattttcttaaatcatagtttttgtaggaaggatggagtgaggtagaataaacaagtctaggattgcctagtttgaataatttcggtgggctctgaggccaggactatccctagttgcctggtacctggccatgggatgcttagggcagggggaatagtggatggagtgtaggagcctagtgacagcctgataaaggaggtgcttggagtatgggctctatatcggttggtttgcatttgaaagatgtgctcccaagtgagtctttactatctctaggaattagccagagatggttaaggcccttagatgtcaaaacatttgggtaaaaagatgtggttgatacaccaacactgttggaatatgagacttctctatgcctcactttcctttggatactcttgttcattcatattttttctttacttaaagttaggtactctgactttgcctattatgttccttttatgattaataataacttgcctaagtctagtctttactagagacaacaatcatcaacttaattcactcaactctccaaagctaatgttattacagccaatttgaaaagtgataaaagggtatggtacactaacactaccaatagtgatagtctttgtaggcaatccataggtgaaaaaagtccttacattacaaaaagtataacatatgatggtcattatttgtcaagaatgaattccatttgagttccattcaaaatggaattttcatttcatacctacagctactgggaactgttttctgtttgggaatcagtctcttcatggccaaaacagagccaaggccaatccttctgtaggtctattcattaggctattttaagggcatgacccccaacaatcctcagtggagcacattattttacaaaaatcataaagcaacgaaaatctttctgaagaaaaactcctgagggtagtgacaccatccatatcattaaacaatttgcagtggttatcaaaaagtattttctcacattagctaatacaataaatatagtagtatatccaaaatcttggaatcacagcaagccagttaaaatttcttaatccaaaggcctatgtgtagtagaatagtcacatatttttgtggggccaatcaggaagtgatctttgtcattgctaatacttcatgttgactctacgttaatactgaagatgagtaaaaacacttttagcatagatagatgatagatagatagataggtagatagatagatagatagacagacagataggtagatagatacatagatgagacatagataaaaagcaacctagttgtgtaagatagactcagaaaatcatttggactttttttttttaatcaagtctgggaaatcttggatcatggttgcaaaatatcttaccctttttataatatttaatacttcagatttgttcatttgttgcatggctctgttggtattctaaatatcactgtccccacaaatggttgaacaagtaatccaaagacaaaaattcaataaaagtcatgcttttaaatatacaaactaaaaatcaaatctctacaggccaaaactctttgtcaagaaaatcgacaatagtggagaagacctggacagttcttgaacatcttttctgcagctttggctgcataaggaccaaaaggggatggggggtggggagaggggaggaaaataaaattattcccatagatttaggaaaagatagattgttacacagccataataagtagccaccagaaccagttttatacctgttcaactgattaacaactcgtctcaatgaacatgcttttgcaagccaactaatcaatgtcagctcctggcttctgaaagtcagccagtcagtgcccctgagtgccaagcaatcagcaatagcctcaccctagtgactctgtttctgcagataatgttaactcatttacacctctgaagtttgccaatccctgaattccatgcttccccaaaacccagtataaatcagctgtctgttgtgctcagcaagattgtgtctgattttcataggtctcctttgctattatttccaataaatgcacatggtctttgtatttcacacattgagtagtgtcaaatccttcgacagctgccaaagtatattttcttgtgggacatttggacttggacaacttttcttactatttttcttcaatgctcaaaacaaacctaacataaaggatatttattcttgtttgaaatgatattcagcatcagcagaaatagttaacatgctatcagaacttataaaatcaacatttagtattataagaaaatgaatctctctgcagatcattccagccagaatagtgatgtttattgctttgtacatcattgaagtcactgattccaaaatcagctatttcaaagcagttgtggattacatttagggtgattgtgtcccacatagcatagcaacaagattcttcactgctatcaaaaatattccattaaaaaatctatactagaaatatttcttcttattttacataatatactaagtgcataaaacttttaggtaattaattatgccttcatctaaaaaccgcatatatattatggtactagaggacaaaaaaagatattgcaaatactgaaataagtccccagttcctttgggcagcacgtttatcaaaacagattttatctattttggcaagctattctcctctctaattgtaggaaccatctcccaaacaatcttccaacatcagtggatttaactttaaatatacatataggagatatgtgtatatataggggattttcaaatttttctacaaatggtcttacttattagtctcagcattgtagcacagtcagacttcctcttaatgaatgtatatatgtacatatgtatgcataatatatgtctgtgtatatatttttccttgagaaaaatgcttttcaccaagaactaacatctggcttggctgaagattatagaagagccccatcttataattattaattatgcccatatgcacatgcttatcctgaatagatctgctgatttcaagccaaatattagtagccaaaagagtttctgcagatgctgtatattttagagtaatggcataatgttctgacaatgccagcaattgacctatatctccattcaaaatgtaattgtattaatcttttatttagaaaaatgattcagatctaatttttttcactctagattagtaaagcaatctaagaatttcgttttataaattaaccttttgtttcccctctcattctttttaccttccttggcaggctgtttttctattctgttctggtttttaagatacatacatacacacacacacacacacacacacacacacacacacacacagatgtaccttggagataatgtaggtagggttccagatcaccatagtaaagtgaatatcacaataaagtaaggcatatattttttttagtttcctggcacacataaaggtttaaagtatactgcagtctgttaaatatgcaatagcattatgtataaaagtgtacatacctcgacttaaaaatgctttattgctaacaaatgctaattatcatctcaggcttcagaaagttgttacttgttttgcaaatgtagggtcttgcctcaatgttggtggctgatcagggtggtggttgctaaaagttgaaatgtctgtggcaatttcttacaataagataaaaatgaagtttgccacatcaattgactcttactttcatgaaaggtttccctgtagcatgcaacactgtttgatagcattttactcaaagtagaacttttttcaaaattggagtcaggataaaaagaaggaggttaatggttacagaaatacagttagaagaaacaaattctactatttgatagtacagtagggaaattatggttaacaataatttactgtatatttcaaaataactagaagaagagaattgtaatgttccccaaaacaaagaaaagaaaaatgtttcaaatagtggatatcccaataaccctgatttgatcattgtacattgtatacatgtatcaaaatatcacaaatgccccaaaatacatacaactataataaattgatttcaaaatctttattttttttttttgagacggagtttcgttcttgttgcccaggctggagggcaatggtacaatttcggctcacagcagcctccgcctcctgggttcagccgcctgggttcaagcgattctcctgcctcaggctcccgagtagctgagtttacaggcatgtgccaccacgcccagctaattttgtatttttagtagagacggggtttctccatgttggtcaggctgatctggaactccagacctcaggtgatccgcccacctcagcctcccaaagtgctaggattacaggcgtgagccactgcgcccagcctaatttcaaaatctttttaaaactactaagaaaatttttaaaaaaatggaagttaatcatctcaaatcctgccactgctttatcaactaagtttatgtaataatctaaatcctttgttgtcatttcaataatgtttacagcatcttcaccagaagtagattccatcttaagaaagcaatttctgtgcttatccataaaaagcaatttatcatttgttaaagttttatcatgagattgtagcaattcagtcacatcttcaggctccacttctaattctagttctcctactatttttaacacatctgcagttactttctccactaaagtcttgaacttcttgaagtcatacatttggattggaatcatcttcttccaaattctgacaacattgatattttgacctcctcttatgaatcatgaatattcttaatgtcatctagagtatgaatcctttccagaagcttttcaatttactttgcccagatccattaaaatacaagcacgttttattttattgcatctatttcttgaaaacttttttaacccattgaattgtcttgaaaattaattgaatatgaatttgtgaatctatttctattttgtttctttgatctacaaattttattttcacaaataccaaactgttttgattactgttctttataatgtcttgagatcaggcagggtgagtccttcaattgtgttccctttaaaaattgttttagtggccgggcgcggtggctcacgcctgtaatcccagcactttgtaaggccgaggcgggcggatcacgaggtcaggagatcgagaccatcctggctaacgcggtgaaaccccgtctctactaaaaaatacaaaaaattagccgggcgtggtggcgggcgcctgtagtcccagctactcgggaggctgaggcaggagaatggcgtgaacccaggaggcggagcttgcagtgagccgagatcgcgccactgcactccagcctgggcgacagagcgagactaggtctcgaaaaaaaaaaaattgttttagttattcattaaggtttattttttgcatttccatataaattttagaattagttggtctatttctataaaaaggcctgctaaaattttgagtgatattgcattgcacttacagaaaattgggggtagaactgccatctggaagctattaaatcctctaattcatgaacatgacatatctgtcaatttattaaggttctttaatttttgtcagcattgtttttggacttttcagtgcagaggtcatggacatctttaagaaaacataaaggccattgacttgaagaaactatttgaaacatgtaaattattccaaagtcttgtgtacagcatatgtaaaaagctcttacaactcaataaaagagaagaaatagcccaatttaagaattaacaaaatattttcgtagaatcttcacaataaaaaaataaaaatgaccaataaacacaggaaaagatgctctacatcaggagtcaacaaaatatggcccatgagccaaattcagccatccacctattttcataaagctttatttaaacacagagatgcttgggtttttttagtgtgttatcaatggcttctttcatgctgcaacggtagaactgagtagttgccattgagactgaatcacctgcaaggcttaaaatacttactattcaaccctttatagaaaaagtctactgactcttatgtcgttaataatcagggaagtgcaagttaatactgtaataaaatatatagccactatatggagcatatatgctatataatatatatgctatatatatgttatataatatatatgctctttatatatgctatatatatgctcctatatagccactatgttggctaaaagtgaaaaaatgactactataccaagtgttgacaaagatgaagtgtaattaactaagttagatctatttaaggacatattctctttagtgcgaagacttctccccgacctgatgttgccattatgtgaggaaggagatcccatgaagtgactccatctgacggccagtttctgcctctgaaggaaccccagagcagttgcggtgtcactgtttcagtagccctgttctctcctggtacctccagcatcccaatcaattcctccagatccgcctgagacatacctgacctcagcaaggacaaaaatctcctttcatctgaagaaatcattggctcaagaggaggactgagccacttatttcagtgttctgatagatgtaggggttgctgaaccgttttaagaagctgtaggaaattgtttgatgtaaactccctatatggccacaagggggcaatgcttcttcaaagaagattaacatttgtccaaatacacatattcagcaattagccagagattatccttttaaaatagtaaattatctcctactctgtttcaattcacgtgtctctttcattcaatgcatctatgcatttatccattcatctacctaactagtatctgtatttattctagtctaacagagtggaaaacatcactttggaagtcaacacttttttgaattatacatgttatccttcaagcccacattaacttctgtagtataactttacaaggttttcacccacatacagcccaatatccagtcacactaatctgtgcctaaaattcccttatccattctttttatggggaaatctatcatggtttgtggcccagttcaagcatctccccatccgtactcttctttgactgggtccagaaacagatttcatcaccctttccttcgtcacatcatctagacacactggtgtctttggcaggttccattggctgatacctgagtcttgggactaggttgactgaagacttggactgtgtctctttcgtgaatgaaatgaggcccaagtactgcctaatttagtaggcactttgtggacagtatatatgtattgaatatatgcatatataaattaaaagaaaagaaagcacatcaaaacttaaacaacttttaaaaagcaccttagggtactggggaagaaaaggtttggattgtagattgaggaacgtggaccattgtctcctattggactgcgatggtgttttctttgagtggatttgagatgacaccaaatataaatacaaaaaaatcatttttgtgcttctgaaaaaaatgtgcttctcatgttattttaacttatatgacttataatacagatcatccctatttcaggggtgctttagaatttatcttcaatttctcccttgtatcttgcctgtgttaatatcaaaagttaaatttattctttatattttcatagttgatcgattttgaagtgtgaataaaatatcgaatgtttattcaaactcaggataagagccaccaaaaatgactgcattacggatggttatagatctatatcttctgcagaatttttctatcctctctttccatttaaagatcacagctcctccagaacagataattccagtatttcctattttctttttctaggtacatttaaaaaaatatttaatttacctaatgtgtaatttagaaaaaaatatggagaaaaaataaaattgacttaattgtattatatcatttctgaggatcatctaaaatatggaatgaatacatctgaaaaattgcaacaaaatttaagttctctgaggacaaagggaccatatattctctatgttctgattcatgaccttagcttgtaatggggtattatgcccattgtgtgccctcaataaactttattaatactcacaataaaaaagaaatgccactgtacatgttaatcgtgcggtttcacaagagttcctctcttctaccattgtaaaataaggccctttctattgacatatccagccatcttaaaggtctgaggaaaagttgagggggcttgacagacagaaattctaaactgatgcttatctgtgtgtaaagaaaggattactgattcccaatgaatatatcttcagcaattctaaatttggacaaagtggggaagtgcttcctttgacagagacagctttaagtgaaagcacttgtgaaagggcggggcctgctgaaagaattcagttgagggtgaatttacagagtttcagctggttgggaagactggaagaccacctgggctgtcattgagctctggtgccaggaggaatggacaagatcttaggagcatcatttttagttctgtggcttcaactatgctgtgagttatggaagagaaactccaggatatgttactaacttgggtgaatgagaaaattggggtacagacaaactcatgcaggtagacactttaagaagaaaatattattttggggcctaatgacattttgttatctctctaagcaggggtgagtggccaacagaaggagaaaagtgaccagcagcaggtgaaacaaagtcctcaatctttgatagtccagaaaggagggatttcaattataaactgtgcttatgagaacactgcgtttgactactttccatggtaccaacaattccctgggaaaggccctgcattattgatagccatacgtccagatgtgagtgaaaagaaagaaggaagattcacaatctccttcaataaaagtgccaagcagttctcatcgcatatcatggattcccagcctggagactcagccacctacttctgtgcagcaagcacacagtgctccccaggcacctgaagcctgtacccaaacctgcagttgaggttccagccaaaccccacagtgggagcttacgtaggcagagatgtagcctagttttcatctgcatatgcaagtgataaataaatgtataaacactagtgtggcagtatgagaatggtaattaaagaaaagaaacttagcttaataaatgaccatctctaacaaatgttttattatagttacagtatttgaaattgttacaagcatccagccagttttggggcaactgggaattttatgccttgctgatgggatgcaaatcagtattatgacactggaaaatcatttgccagtttcttataaattgctcttaacataggaccagaaattccactcctaagtatttatctataataaatgaaaatatatcttcacacaagacttttgtttacagcagttttaaccataatagccccaagctggaaacaacccaaatgtccattagctggggaatagaaaaataaattgtggactattcctataatggaatactacagagcaataaaatgcaataagctagtgatacaggtaacacatgacggatctcagaactttatgcttcattgagtgaatggttaaatatactgtggcacatacccacataatggaatatgattcatcaataaaaaacatgaattattgatgcatgcaacaactttgatgaatctcaagggcattatgttgagtgaacaaaagtcaatctcaaaggctatataatgtgtgatttcccttatataacactatcaatatgtaaaaattacaggacagtggttgccagaagttatgggtggggagtgtgtatatagggagtttatttagggtgatggatggaatagttctgtatcctgattgtagttgttagggaaatctatacatatgataaaatgtcacagaagtatatatcaaaaaaagagtgcatataaaaatgggtgaatccaatagcaaagacttggaaccaacccaaatgtccaacaatagactggattaagaaaatgtggcacatatacaccatggaatactatgcagccataaaaaatgaagagttcatgtcctttgtaggaacatggatgaaactggaaaccatcattctcagcaaactatcgcaaggacaaaaaaccaaacaccgcatgttctcactcataggtgggaatagaacaatgagaacacatggacacaggaaggggaacatcacacaccagggcctgttgtggggtgggggatgggggagggaaaccattaggagatatacctaatgctaaatgatgagttaatgggtgcagcacaccaacatggcacatgtatacacatgtaacaaacctgcacattgtgcacgtgtaccctaaaacttaaagtataataataataataataaaagttctttaagcaaaaaaaaaaagggtgaatcagaataagatctgtagtttaataaatactattgtatcaatatcaattttctggttttgatactagtacataatgataatggtacatagctatggttatgtaaaatgttatcattagagaatgctgggtgaaatgtgcaagagaactctgcgttatttttgcaacttctacgtgagtctaaaattatttcaaaataaaaagtaaggatgtagaaaaaagatttttaacaaacatttacaaatttttggaatataaaattttggaatgtggaattttagaacatggttggaacataaactgggcaaccactttggtggattttcataaaactaaatgcgtttctaccacaacccagtgactcacatctaggcatttacccaagaaaaataaaaatgtgtcaacacaaagacttgtacaagaatgttcacaacagttttattcataatagccatcaatttgagaaaacacccataaacaagatactaaatcaataaatttttgtgtcacacacattcaatggaatattaatcagcaataaaatggcctgaaccactgatacacataacagtacaaacaagcctagattatataatgcctagcaaaattgccaaatacaaaagggtatatactgtttgattcaagttatgtgaatttctaaagtagacaaattaatccacggtgaaataaagccaaacagtgattacatctgtgagtgggaattatttgggtggagcacaatgaatttttataagctaaaggaaaagaaatgttctatttcatgataggggtgtggtttacaaggctgtttgcaattttcaaaactcatctaactccatacttatgacttgtttatttcactatatcaattatacttcaattaaaaataaactacagaaattaatcaaataggaaacaaaaacaaaacaattaggggaaaatccaatgccgaataaatttgaagaaataaaagagttaaatactcgataatgttgataatgaggaaaatagaaaatagttaaacaatgcagtacgctgaattctggcccccaaagatgtccatgtcaaaaaccccagagtctatgaatatgctgcttcacatggtatattagttttctagggctgcagtaacaaagtaccgtggactgggtggcttaggacaacagaaatttactgtctcctggttctagtggccaaaagtctggaaccaaggtgttgcagagccatgctccttctggggcgctagggaagatttgtttcagacctcgttccgagtatctgatggtcacaagcatcccttagcttagagatggtcatgtcctccctgtgtctcctcccatcatctttcctctgtttgtgtctctgtctcttcacgtgacattcttttcataagggcaccagtcttattggactaagggcccgcactactccagtaggatctcatttcaacttaactaatgacattggcaatgaccctatttccaaaaaagttcacattctaagcttctagaggttagaacttcaacatatgaattttctggggatacaatttaaccgaataacatatagtgaaaggaactttacatatatgattaattcaaaaatcttgaaatgagaagatttatcctcaattatccaggcagacccagtggaatcacaaggatctctataaaagggaggcagtagacttggaatgaaagaaagcaatgtgatgagagaatgagaacagcctcgaagttggaaaaggcaaaaaaaaaaaaaaaaagaaaaaagacagattattccccatagccaccagaaggaactcagacctgctggtaccttgactttagtccagtgaaactgattttggatttaagatctccagaattgcaaaataataaatgtgtgctgttttaagccactgattttgtggtaatttcttatagccacaataggagactaataaattcaataataggagagattaaaaaggagacatgtctggagataaagtagaaattaaaaaaaaattagcataagttaagtacaatttaagccaataaattttaaaactttaaaaagtagaaacaatttgaatgaaaaacatatactaccaaaagtaactcaagaagaaatagaaaaactaagtagatttataaccattaaattatttgataattggaaatgaaaatccctaaagatttagtaatagaagggaaatttttaacctgcatgtgcgcccactacaaaattaaaaacaagacacatgctggatgcatctgtaaataatataaccaataagattttagaaattaaggttagatggggaactcttacaaataaataagaaaacattcaaaataagaagagacaaggatataaaaggcaattcaaaaagaagaaataggaatggccactaaatatgtaaaacatcaacttccacagaactcgaggaaatcaaattaaaataaattattgtttcatttctatttgatcaacaaaatctaaaatatctggtaacattaagtattggtaggaatacatggagatgaagctgttacacttttccagatgaagaaaaacaccacacagagaatttaggataacaatttgcctaaactagttatgaatttgcacatatctaataatccagcaatacaaatttctgatatctacataaaggtagtcaaaatgtaaactaggaggcatttacaaggatgctcactgcaaccctctttaaaaataagtataatcacaagaaaaaaacaaccccatcaataagtgggcgaaggacatgaacagacacttctcaagacatttatgcagcctacagacacatgaaaaaatgctcatcatcactggccatcagagaaatgcaaatcaaaaccacaatgagataccatctcacaccagttagaatggcaatcattaaaaagtcaggaccacttttacactgttagtgggagtgtaaactagttcaaccattgtggaagacagtgtggcgattcctcaaggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccatacaaatgaagagttcatgtcctttgtagggatgtggatgaagctggaaaccaacattctcagcaaactatcgcaaggacagaaaaccaaacaccacgtgttctgactcataggtgggaattgaacaatgagaacgcatggacacaggaaggggaacatcacacaccggggcctgttgtggggtgaggggagcggggagggatagcatttggagatatacctaatgtaaatgacgagttaatgggtgcagacaccaacatggtatatgtatacatatgtaacaaacctgcacgttgtgcacatgtatcctagaacttaaagtataataaaaaaaatacaatacattcattaaaaaaaagtataatcaatagtggaataaaaaatagtggtttagtcatacaatggaagtattagccattacaagcaaagaagtggttctatacatattttcttagatgaatcttacaaataaaatgttggatgtaaaagcagaatgatacatactgcatggcaccattaataagaaatcttaaaatacaaaataatgcagtatattgttttgtaatacatacctgtaatggttaaattctttttttttttgagacggcatcttgctctgtcgcccaggctggagtgcagtggcacgatctcggctcactgcaagctccctctcctggattcacgccattctcctgtctcagcctccggagtagctgggactaaagggagcgccaccacgcccggctaatttttgtgtgtgtgtgtttttagtagagacggggtctcaccatgttagacaggatggtctcgataccctgacctcgtgatctgcccacatcggcctcccaaagtgctgggattacaggcgtcagccaccgtgcccggcctgtaagggttaaattttaaaagacatgcgtggaaacttcccaagagtggttactatctttgaaagaataaaaggaacaaggactattgttctagctttgtctgaaatgtttgagaaaatctgaaatgtagagagagaaagaatatttttagaaaacatagcaaaattcatcatctgtttatgtgtttattctcattgctggatacgaaggtgcctgctatataattttctgtacttttgctcatgataattatttcataaatttaaaaaataatttttaaatggatagcgacaatcatagtttttactatcttcaccagtccacagaagagaatagcaccttcattacctacaactttgccagatgtatttctggtaggccacataaatggcaataaaacatcaattggaaaaaatctctaatttatgaataaaaggatgttcaacctgaaataaacaacccaagactctttcccctgaaccacaatgcatacattttcaatatattaaaaagaggatgtggaaaaaaaatccaattagttacctcttagcaatgggagatgtggccacaaaatgtcagcattttgtgaatattaactcccctgggctctcaaagtttattttacttccttttttagcagtttgaaaaatcgaagaagaaattggaatagtatttatgtctgattagagtggctttcattggactgaaatattcaagaataaagtagaatacagtgcctaggatgaattcgtggtcagcatgagaagagggctgttgtcaagtatatgagagagaggaagaaatgggaagagctgggagtctcaacagtgattctgtggcttcatacagatgtgagtttggggatttctacaaagaaccaggaagagtctgaggacagtttgccacagaatcactcaactattcccatttggatttctttatggggcagtccaacaaaaatacagcttttggaatttggtgctttgacataaactgctctatcagatgaagtttcagcataaagtggaaaagaatcttcattctttcaatgtccaaagagggaaatatttttattttggacatttatactattaatagttttgaatatttttactgataaagcagcattttgtgagaagccttgtcttcctgataattattaaaaattatagaattgcaccaaacagtacacatgcactcatggcaacagcatagctaaagatttgaattcagagggcccatggattctcccatcctagaacttcaaataaaattaagcatagagttatagtagaaataataggcctttgccgttactattgacagtagaacacacaactggagaaaatacagaacctgggagtcttttttttttaatctcatttgtctgagctgttgctttgccattgtgaagttccaattcccttggtttgatgggtaagtaggaaggacgggaggtgatgacttctggtttgtctcctgtgtcaaagccaaggattggtgagcagcttcacctttgactcaggttggtagcaagtgaacaatcaaaacatgaatgtatatttgtaatcaaagccatgattcataataaattggtttcagataagcccctcagatttatcacagatcaatttcctaaacttggaaattttaaatgactaatctccttttaagaattccttcaatattgtttcatgcatgtcctttaccagatataatcctttgtcatttgttaattaaattataagaaagggcaaaacgatgtttaggatagaaccaatttcccagcctagggattatcatagcacattcacacttgacccacccagaaaccacatttcagaggcagcttccatacagaactgagggaccctgcacctgtactgtcagggtacagagcagggctatttcaacaggaaggaaatcctgccatcatactgcttcccagtctactgtgagtattcatggtctccatctacttaggtacaaataattgcaaaccagagcatggatacctctcagcactcagaggtgaaacgggactaaggagtagatgtctcaaacaatgagaaactattccctgcaccactcagtgatatgctattttgacctttataaaagaactggaaatgttttagagaccttgtctgcactttctttcttagctatctcttggtccctttatattaattcgtccattaagttagtgaaactagaggctgggttcacacatataatcccagcactttgggaagccaagataaggtcacttgaggccaggagtttgagaccagtctgggcaacgtagagagactccatctctacaaagtaaaataaaaatttagccaggcctggtagctcgcaactggagtcctagccatttgggaggctgcggtgacaaaattacttgagcctaggagttccaggctgcagtgagttctgattgtgccactgcacttcagtctgggtgacaaagagagacccccaactctaaaataaaaatttttctatttaaatttttaaaaaagacaatgaaatcacatggaagattaacatctaaattccatacaatcacgtaacagcatacaaaaaattcagccaccaacttctgtggtattgacatgcacaaagttcttgcaaccttcagataacacgttctgtgggagtatattatagcattgtatcatttgcatcacagagagatcttgtatgcttatcatgacaaacaatgtcttatgcttatcattaaaaattttaaaaatgcccagccacagaatgtaacaagtgagactgaatactttggatcaatgggatagaaaatgtgatatcaggacaattctaggacacatgatctaagaagtataattctacttgtgaaggcaacaggactgaatatactgatcctcctcagtctagtaaataaaacttagtgtcagattttgaaatgattacattttattgctgttataatttcataaagagataaaaaactgagcagcttctgaaagtcgagaaggactgatttttatcatttgattttgaagtagctttacttattatagaacttaactagggccctagacctcagtaaggaggaagaaagagatgcagtaattgtttagaataggactgcctttcacagagaaagtcaaatatctgagtatttttcttttaaatttaattagtttctgatggcaaaaagtaaatatatgctaaatgaataatatcaatgtatgtcaactggttcaactgcagttcccctcaatacaaattgcttttcttatatcccttttctaggttctgtctatcctaatgactagggaaagacaactagacaaagtaaagattcaggggtgagccagacatttttcctcatctgtgcatagccatgtagtctatgaacatgagactcaatttcctgtttggggagatagcatcagaacccaggaactacatatacacaccgcagggccctggtaggcactgaactttgagcttcaggcagcacaactcacatttgtgcaaagagctacatgccacatgctgttctccagcctgctgtgtgtatttgtggccttcagctactctggtatggatggttccaagtgtgagtaaaaatgttaaggatggaaggattccaaacaggcatatggtatttctcatggacttgaggaggaaaggagaaattgtaaaaaagcgagcatattatgattttagtttggtttgtctctgggtcctaaattagtctagctcttacgatattttattcactatatcaaaggatcagctctgttttctgatttttcccacaggatcaagtgtggcccagaaggttactcaagcccagtcatcagtatccatgccagtgaggaaagcagtcaccctgaactgcctgtatgaaacaagttggtggtcatattatattttttggtacaagcaacttcccagcaaagagatgattttccttattcgccagggttctgatgaacagaatgcaaaaagtggtcgctattctgtcaacttcaagaaagcagcgaaatccgtcgccttaaccatttcagccttacagctagaagattcagcaaagtacttttgtgctcttggggaactcacagtgtttgaagtgatagtaaaagcaaaacaaaaaccctagggctcaataagagaacccctctactccccatcctttgctacaggagccaatctgaaatgcacacctgcagatctcaggcaagagagggtagtgactgtggtctgtggatttaatctgtggtctggatcagatgatttaattccaagtaaaacctccttctatctcacttggaaacaggtgttcagagcaactttcttctaatacttcaatttttacttaaaatagatcatacagaaaatgtgtaaagttgtctaaagttggaaagacttccacataataacttaaagtggcagtctcacttaacgatgctcacagcagaaatctgggtctagttatcttgaatcaccataaaaatcatttccttagccctttcctcttaagctttatgtcagttaggatacaatcagggaagcagaaccatcgtgaaagatgtagaataagattaattataaggattagacctcatgcaattgctggaacgggtggctctcggaagttacttagttgtttatgtttttatgaaattgtaacaggaataaaatgtaatcttttcaaaatctgacactgagttttatgtactaggctgaagaggatcaggacattcagtcctattggcttcacaagtagaatagtacttcttagatcatgtgtcctagaattctcctgataccacatttctatcccattaatccaaactattcagtctcacttgttaaattctgtggctgggcatgtttttcatgtgtaaaataaagtcgtgataagcatgccagatttctgtgatacgatgccataatctgctcttactcctatgcaaagctgtttgctgaatttactctaggtcagctagactcacatttgggaaggagagttgaacatggacaagagcatgcaaaagctgtgatttgtaaagacattttggaacccatggtgacaggtggaacccacgaggacaaactaaaacttgtctgtctcttacctccttcaatctcatagtgttggtgaccttcagaagaaatggtgttatttgctatcatgctccctgggtacttggcccaagaaaaagagaagctgaaagaggagatctggggggagtgggggagttgtgaatcaacaataagatgagttagcagatcagagcaacatatgtgagttgccacagtgcctggagcctggcacctgccttacacaatttttttcaacttaatcgagaacaatatagggaaggattttcttagaaatatatttccaggtagttacgacgagacagtacaaagttaccacaatacccccaccttgtaaacttgacatccatatgcacctcttttaatagcacttagctttcaaataaaggcaattttaaaaagcatacttcctgccaatatgatgccactgttcttcattcaaccacacataccctaaccctctcccctaaagagaatacaaagtatttattcatctttgggtgatgttctttcctcttctagctgagtcacactctcccattgatatcctgtagtttagcttctgagatataacaagctataagagtaacttattaacatatctttcactattatgtataggcaaatgggaggagagtaaaaaatggttgacatgtattttaatattttcatatcacaatgaaaaagaaatgtttataacagtatagtctttttttccacaaatggtcacatgattgtagctggtttctataactacctcttccattacccatttcataatctgttttcagcaagcacctcaactcactggtacacttgactttctataaaacaagctccttggtcaggagcaatgttatacagaatgccataaagttgagtaaggaattctctaagcccaccactgtggttttgccagaagcactgcagatgtggaaggaaagtccatattcagaatgtctaagtggactaaaacaaagcaaaacttgccagcagccagagaaagttgatatatcatgatatatcatgatatatcatgtctttaagaatgattgctgaattctcatcaaaatcaacagaagccaaagaggaaaaagtatttttagagtacttacaaaacaaacaaacaaacaaacaaacaaaaaaactctctagctagcttcctatgaacatgaaagtctaattttaaaccctttgtcaaaaatcattgttaaaaaggtggaaagtcagtgcacagattgggaaattatatttgcattggtgtatttctgaaaaagattcaaatgcagaatatataaaaaacttgtacaagtcaacaagcaatgagaaaacaatacaaatggccaaaacttgaagagacacttcagaaatatgatatctaatagtaataagcatacacaaaaagcacttaatataattactcattaggaaaatgaaaatgaaaccccattgagtgatccccctgtgccctttcagcaccccagttgtattaatgtagccaggaggaaatgaccacaagaggataatgaaaaatagtgactacttccaggggaagggatggccaagtaggttttctagaaacttctgttaaattaagtttagcctaaagctgcctccttatttatttaaaactcagggcaaaggtttctccatacatagggccctgtaacctaacaggatgcataaacaggctacagtctgctctctaccaatccctaagtttcggccataggtggccaactgttcaaacatgttcaaataaggcaaatgccaagctttaaccaatccatctgtttctgtaccttacttcctttttctataagtcactttactttctctgtccataaatattctttgaccatgtggcagtgacagagtctctctgaacctgttctggtctggtggggggctgcctgaatctctaatcgttctttgcttaattaaactctgtaaaatttaattcgtctaaagtttttcttttaacatgtccatcattgaaccatgttcagtggaagaagaaaaagcagtaacaggctaaagaccggaacactgaaggaaagcaggttttactaggaaaaaagaaagttggtattcattggccatactatatgtcaggcactatttatacatttcaaattcattacctaatttaagcatcatacaccctacgagataggttttagtcttccaattttttatatttgggaaatgagacacagctttccctaactttgaaaagcatctctaactaaagtcagccagggtgtaacatcttagagggctcctaaaaaatcaaagtttggactatggagaagcaaatagccacaaagcagcagcattggctttctcagtgaggatgacaagatgacaaacctaggcacaaattgcctcaggatcaacagatggaggaaatcaccgactaagtatttaagagtgctgaatgtatcagtgagtctcttctacagtagtgtgctatgaagcacaagaggctagagggaaagatgagatactattccttaaacactccaagcgggcttccatatcaaggcctttgcccactctgcctgcaatgctatacccccacaaaacctcatggtgtagctctgaactcctctacgtctttacgcaaaagtcaccactttgtgaagcctttatcgaaatctttctattgtatattccttctttgagaatcaggctctagcgtattccacgtgttgagaactaaagcaccaagttctgaagcactgccacctggtgtcccgctgaactatttggtgaggtttacgctggcttccctgctgccctccagtgttcacgggctaagctgtgatgaagcctggttgcaataggagctagcatttctgaaccagtcagtaaccttcccatggtagtaatcatgtgagacaggattcagcaggactggctgagacttttttttttctttgaaggaagcaatttttatcccttacgcagcttgtccctgctactgtgtcttgtctccattgcctggatccagacctcacaagttatttatgtatttatgtatttatttatttatttatttattccaaggcagaagaatttttcttagtacagaacaaaatggagtctcctatgtctacttctttctacacagacacagtaacaatctgttctctctttcttttccccacatttcccccttttcttttctacaaaaccgccatcgtcatcactgcccgttctcgatggtcgctgtctcttcggagctgttgggtacacctcccagacggggcggccgggcagaggcactcacttcctagacggggcggccgggcagaggcgctggctgggacttttttaaatttcatttttaaaatatttttcccttaatatgtgaggttgattgatttcaaaatggcaaatataatatatgggatggtttaagctaatagaataccttggaaacaaaggttggcattattgcacaaggtgggaagtttttctctattaagtgagagttcatctactgctctgtcccttactgtagtatagaaatatcctaagaagtgagaacaagagtcaatgatggagagaaataagccattgtagggaacacagtgcagcatactctctccatgttatcatatgctgcccaacctcccaatatagcatcataacgccactgatttcccactaacagtaagaaacatgatagaacatggatatgtattatagtacataaaatatgctatgcaaattgcaaaatgcccctcggaaaaatactgaattttatcttgtggatagactgcactgcaatttcagatacagtctcccaaccccccaatattttctatattgaatgcatctggttgagtgcctaagatacagaagttattgtattagatgatttattcggttggtgtaaaagtaatttctgctttttccattacttataatgtaatggcataaccattatataggcttggattgcatttctggacctaccactcattggttgaattatcttgagcaaattacttaataacttttatgcttcagtctccttatccctacaatgtggatattgatagtacttactacaaagggttattttgagaaataaacaaaatgacaaatgccaatgcttagcccagtaccaacaaaaagctactggttacttacagaaaaggaaattgaatatgagagagattaaatgtcttgcctagcatcacaaagtgtcagagttgagccttccctccatgccttatgtagagcagataccttttctcaccccaagaataactctctatctcattacagtgctatattgtctttatagagcttatcaccgtatagaattatcttattttgtaaaaactcatttatttaacttcttctcattgcactctagtcccttttctatctcttcaccaccatgttctccatgcctggaacaatgcctagcacacaggagacacaaacaatacatgtttgttgaatgaatgcacaaaaggtaaaattatgtccagagtccttgcaattcaaatattaatataacagtttaagctggattaatctttgtgttatttatccagaattgtcaagatttatatcctgtaagtttcttaacgtaatatttaaatatgtaaaggctaaatagttgaatactagctttggtttatctacattggtttatttttgcactttgggggaattaataaataatcttactaaaaattttatctataaatccctcactttactcactgtggatatgaggtagaaaaaattctgaggcatttttctctgtagtgcatgcatcttatcttttatgttgcaaaagtttttcagaggactcatgtatatgtatatatttttatgttttaaaaaattctgtgtgcacacatacacacacacacacacacacacacacactccttgcataagagttgatatacaggcccactgtttgctcaaaacagagaaagcaaattgaccttgtttcccttcactatcagggtgggtacatttagaatcctccctgatatattaggctgttaagaatgataaagattgatattactagttgagttgtcctgtggccaaagtggggaggaaggaaactaggatcatgcactcttccagaaagagaatctcgtaaggctgtatttagttgccaacaggcttggcctttacttcaggtcaaatgtgtggctataccttgcaggattctgtcctactattatagatagaggaattctccctgctgttagaggtatatcttcttgatctggacactgctccttcaacatgtgggtgaatttatcagtggatcggtgttctcaccagaaatgagctccacagcatgtaggctttctgagtgattgtggccatgacttcactctcctatgataaagttacctgaatgctatgatcttctccatgcatctggagaagaaactacagaaaagaaactactacagcaaagacttggaaccaagccaaatgcccatcagtgatagactggattaagaaaatgtggcacatatacaccatggaatactatgcaatcataagcaggatgagtttatgtccttggcagggacatgaatgaagctggaaaccatcattctcagcaagctatcacaagaccagaaaaccaaatactgcatgttctcactcataagtgggagttgaacaatgagaacacatggacacagggaggggaatatcgcacaccagggtctgtcaggggatgggggactaggggaggtataacattagcagaaatacctaacgtaggtgacaggtcgatgggtgcagcaaaccaccagggcatgtgtatacctatgtaacaaagctgcacgttctgaacatgtaccccaggacttaaagtatgatttaaaaaaaagaatggcttgtttgtctagcagccatccctaaccctagtcctcatgcttctgaactaggagtcattattgaggcttccaggatttcctttactacccatacatttatctccttttctgggaaggaaagctagaagttaaccattgagatactttctaatcctgttctaattttttagaacgtgatttaaatgtatgtggaaagtgctgtcccctgattttagtacataccccatgctgtttcctttgcttacttcagttgttcactggaaaggttttaaaggcacttcatacactaaatacctagaggttaaatttatattctgaaaaaaattaatgctatcttatattattaaatttcccttggatatatcttatttctccaattatattttgggctcacagggaatagggaatgttgctttgtaatctttttttctttcttttcctctcccctagatgaggctgtagctttgtaatttttaattcctcagagctcctagggaaattcaaagcacaaaaattactgtttaaaaaatacatgcatattgaatcaaactaacgttatatctggactgtgacagaagcaagacagcataattcttatttacttttaaacaactttattggagtatgtttacgttccataaattcatccattttaaatgtatggttcagtgatttttaattaataactgatttatgaaactattaccataatctatttgtaaatccttttcaacactctagaaagatccttcatgccaaacttatagttaatctctaacccaaccctggccccaggcaaccggcttacatctttatagatcttccttttctgaacatttcatataaatggaatcactcaatatgtaatcttttgtggctggattctttttcttaaaatagtatttttgaggctcatctgtgttgtagcatatattatgttttattttatttatttcatttttgcttatttattttattttatttattatttatttatttttgttgccgaatatcattcacatcttgtatgaacatactgcattttgtttattcattcaccagctgatggacatttgggttgttctcatttttttagccttaataaagaatatccacaaattagacttccattatttttagaacatatctaacatgtaaaacattcatggtgcatcacaaatgtaggtggcatatcagattccaattataaagtctagagctagacagatatatgttctaattcttaatatgccacttaggtaattgaccttgagtgaattatttaatctccttgagctttgggttattttttgtttgtaaattagaaacagtaatgtctctattgcatgactttcttattagatagatgtacataaagaaaaaggtaatttagatgtgtgcacatttataatttgagggggattcaaaagttgttttttaatgtttgaagattcaaagaaaaatgcttttcctgccacaaatgccatcccacctgtaactccctctaaatttgaataatagcagtccacagttaggcagcgcacttctgaaagggtgtcaattctcgttgtgttccacactcatgggggatttcctcaaagtttatgaagttggcctgaagaaagcagttacttcgactcctctttgtgaaccacaggaaactgaacatagggcagagcgtttctaggacatttatgggagctggtctctgattggctaggcaaccagatgcagaatcctgttttctgaagcagaatatttccacagattttggctgcaaaacgtttttctgctgtgggtacgtgagcaggaaacatggagaagaatcctttggcagccccattactaatcctctggtttcatcttgactgtaagtccaggggttacaggagacattcttagtctggggtgatgatgaggaaggaggaggatgcagtcagacactctaggttttatttggggatgtgtgaagaaaatgccaactctgtagagagaccaatttctatgtctgactcttttttaaaaaaacaggcgtgagcagcatactgaacgtggaacaaagtcctcagtcactgcatgttcaggagggagacagcaccaatttcacctgcagcttcccttccagcaatttttatgccttacactggtacagatgggaaactgcaaaaagccccgaggccttgtttgtaatgactttaaatggggatgaaaagaagaaaggacgaataagtgccactcttaataccaaggagggttacagctatttgtacatcaaaggatcccagcctgaagactcagccacatacctctgtgcctttacacagtgctgttcaggcacctgcagcccatacgcaaacctgtgtctggtgttgcactgttaccagcattgacaaagaaccatgagtaggatggaaaagacaagttcgttgaattacagttttttttcaagaggattgtgcaaacatagaaaaataagcatgctagtgatcataactaactaccacaagagcaaattaagtaaacatattccttatgacagatagatgtcagagtgctaatgaagcataacacatgacctggtaactgggccgttactaaacaatactaaccccagctcccaacagctcattaaccacatcatggagtcagacccattgcctgctcttttggcatgattctgaaagaacccaatagttactcaaatctatctaaaacaatctgggtaaacaaaggcgatatttaccccctcattgttgctatgtcctgaaaacgaattcttctattatactttatcacagcacaaaaggagcatgtcggcatgcccctccctcacacacctggcctggaaatatgcatgtttaataccagaacaggtgatgctgcctcctttaatccattggggattttggttttgctttagttcaacttttcccccacatgaacatttgtatttttatttcttctcacatgtggctattttcatttttaaatatcactgataatatcataaaggagcactgatgaaggaccttcactattttacgtggtctataccccagcttgtactgtgattgtgatattggatgactaactgaactctattatcaaagtctcttcatttgtaatttccaggtatattaagtaggctgagtgtttggtgctctcctccttttgcagatttccaaacaacccaccagtttaaggtcccacttgtactctagaggcatctaattctaagcgttcttgggggctgttaagatgaagtaagttgcttctgggcctcctcatctaaaagctagaatttcaactttctctaaacatctacattaataattatttatccagctcctgtccagtttcctaaattatgctgctattgcattttctctctcttttgtggatttatgtttttaaaaatattattgttattatcacatatttaggaaaaaaagctggtacattttaaaaataataatggagtgtatacaaatctctgactggacccatttagagatatatatatatagagagagaattacttttttcaaaatttattcacaaggtagtaatgaatctatttgactatcagatcagaagcggctaaatttgtaatattatttgaacatatatggaatcagaagggtatagcacaggactgagtgcggagaagctatggttcattgtaccctagtgtcggtggagaagaactacacaaaagaagactgatcactgttccagctgctagtcaaattcccaaaccagctctccattattggcataaagatcaatggaagaatttctaatatttccagcaatgatcttgaggcttgaactaactctgaattggtagaatcaaaaggcatgagtaaaataaaagatgaacatctgactcatttgtgtgtggctgcaacacaatgcctcacagtctcccgcatgtcaaggcacacatagaaattaattacattcatacaacacttcagtgtggaatgacgctgcttgaaaccagcccatgactccaacttccttgagaactctgcctgccttaagccacgatgagatagagatcttcccacacacacgatcaagaaaaatgtaaatctgtggtgcatggtccttacaaaaatatccctatctttatgaaagctgtatgtaaccaagtaaatatggatgaaaattttcagtgtctttggattctaaaactgatctgaaattgaaaataatgtgtcaaattctgattatttatagagacacaggcatgttcttgtaaattttgttagtttagacacatggaaagagaagagtgagtgaaatataaaaatgttaaataagaaacacagatctctgttgattgcagggccccaacctgagcaatcagccacctgctcctgtactgtggctgcacagagctcttgttacctctgatcattgccaccaggtcttctgtgccagtgcagaagcacaaggctggcttttgaaaagaagtttggtgaaacaggcagatgtttcagatcaagctattagagactagcagaaatcagccagaggaagcatacatttttattgttgatttctcacaagttctcaaaaagactatttttcattgaactccagagcttttgtggcttgctgaataacaaactgttgtacaactcacttaagcaagtgccattttactatctcatgatacttctgctccttgtgatgctgactgcagctagggtcctctgggggcttgcctgactagaacccctggagctcacttccatacccggagccttggtgggaatgcggaaggctgggctcatctctcatcccaactattctcagggctttcattacacatggcctctgcatgtggtctctcatcaagatctctctagggcttccaatattacaaaagtggaaggtgccaggcctttttaatgtttaggccagaactgccacaatattatttctactgcattctcatgcatacataagaaccatgaatgtgacattacttggaaaaggggcctctgtaaatataattaaaattgagtcatagagccaacccagagtcaacatagaagggaaatacacaagggcatgaatatcagaagcacgattttgagggcatctttggatactaactcccacaagagctaactaagtaaacatattcctatgccagatagatatcagagtgctaatgaagcataacacatgaccttgataatccagtaattatcaaggtcatgtcaatttgaacttccaaatactgctcgtatctgtttctctatttctatattgcttactgctttcctaatttaggcattcagcacctctcacttggatgattgcaatggcttcctaattgtcttcctgcctctattctcaactctttgaatctaacttctacatggcaactagagttattataaaatgtatctaataagatcacttcctgcctccctttgggtagtaaggaaccactagaagttgaaactctgtattaaaactacaaggccggctgggtgtggtggctcatgtccgtaatcccagcactttgggaggccgaggcaggtggatcacctgaggtcaggagttcgagaccagcctgaacaacatggcgaaaccccgtctctactaaaaatacaaaaatttgccggacgtggtggcatgctcctataatcccagctactcaagaggctgagacaggagaattgcttgaacccaggaggtggaggttgcagtgagctgagattgccactgcacttcagcctgagtgacaaagcaagactccgtctcaaaaagaaacaaacaaacaaacaaacaaaaatacaaggccatctacagaatcctgtttaccttctattttaatcttccatccttctctcatatatgtaatatatatatatttatattatatatatttatatattatatatgtatatttaaattctaaccctttatgtgaatattaagggccttcctaaatctgaccccttttcccagaatatatttttcccattgtaatatgcacacaggtctactcaccctttatggcccaattcaggcattatttattttttatctgagatttcatagaatctcatagaatctgagatttcatagaataacacttgtaacatcttattataaatatttttgaatctgatcctctcttacaattgttttgacaaaaatatttgccactgagagctattatatgtttatattcaatggaaatgtttcctactaggaaatgcagagattcagtctaagagtgcagagatttcttttactccttgaaccaatgcatggccagcttcccttctcttcctttagtaaatttccacttccaaccataagatctagagagaggctacaagacagaccatgctgcgagttgggaaagggcaagcttgacccgggcgagattcctctgtctgggtttatgcctcctacgtaaactgcaccagtactgctgccctggatgaagagaagaggatttctaaagcccccacaggtgctccttgcacactccttgctcttcttgaatggggaaggagtccttattgccttaaaattgttagctttgtcttcattttgagatccaaatccaatattcctacgaaggaaaaaaaagcatcccagtggcatgcatttcaaaagtttatcttaattcacaagatttgccatttttcagcacatccgaaaactgcttcttggtctgtttccatttcatgcagtaattcagatttagattcactttttaccctacacaaaatgttgagatttccgccattaatacatttacaaggcaacactttaaagacattagatttcttgtagtgggttgaatgatgacagaagatatgtccatgtcctaatccctagaaatagtgaatgtggtgttatttgaaaaagggtctttgcaaatgtaattgagttaagaatatcaagttaagatcaccctggattattcaggtaggccctaaatccaatgacaactgttcttttttttttttttttttttttttttttttttttttttgttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgctgggattacaggcgtgagccaccgcgcccggccgacaactgttcttttaagaaacacacggatgaggctgggcacattggctcatgcctgtaatcccagcactttgggaggctgaggcgggcgaatcacctgaggtcaggagttcgagactagcctggccaacatggtgaaaccctgtctttactaaaaatacaaaaattagccaggcatggtgatgcacacctgtaatcacagctactcgggaggctgaggcaggagaatcgcttgaacctgggaggtggaggttgctgtgagccactgcactccagcctgggtaacatagtgagactctgtctcaggaaaaaaaaaaaaaaaaaaaaagaagcacacagatgagaaggccatctaaagacagcggggtagaggttgcaattatgcagccacatccaagggatgcctggagccaccggaggctggaaaagatgaggaaggatcctcccctagaacgttcagagggaacatggccctgctgacaccttaatttcagacttctggcctctaggggtataaagaaaatacatttttgtcaagccaccaagtttgtttgctacggcaaccctaggaaagtagtatctcctaaaggtgatatttctaaatagctacaaccaaaccttgattgtttttatagaagggcacattgtcaaccaataccatttgaatatggtattgatatggttctaatattttaatactttttggaatattttaagtttaaatcgtgacacagtgtatatacaaacacacactttttttttttatcatttaatgaacacctgagtatccacaatttacccgctattagagtaggacatgttggtgaataatagacaaatactttccaatagaaattgattatctgttagataagactttttttctaattatattaatgtcttccctcatcacgctggcatgtgtaaaagtaacatagtgggatggcagacatgatctctaaattggataatttaccagggaaatcagggtgacgaaagagaaatttgtatttcttatcgtctgttttgaggtaatgcgttgtctaacaataaatcacaagtgtctcccacatttattaaaaagtctgtgacctaatatgtcccattaaggcacttataagcatgtgctacatggcacaacatgatgcttagtgacaatggaagcgacaaaatggaactttctcttttcttcggatgccctagttttaaatcacagactccatttttaagaggcaaattattcctccttgaacaatgtcaccatcagtaaactcttttcttccaatccttgacacacatacataccacctaaattagaaagcagctttattaataaaataatctgttgtcaaatcagcaatgtttgagtccaccacaggggggcagcatcggcaaacatagactctcctctgagagggtgggcaaaatagtgtgattggttttctcaacttgcagtcacctctttccctttctttccaaaatgcacacatctactttccaaaatagaccgcaactatttctattgatctggaagaagcttgtaccaggcaacccatttaggagaagttggatgaagagggagagggagatgctactcatcacatcaatgttggtcttatggatgcaattgtcacgtgagtttgagacgtccctgactgcttccagagaataaatccaacaggatagagaagtatctgcaggcagggaatggactttctgtttgagaaacaagagttaagacaaagggagagaaacagagagaaagagacagaatggataaaggttgagggagatgggaagggagacgtggacagaaaggggaaaaaagaaaagaggagtgagagagacctgcgtagctcaggagctaaatatctaatctgattttatgtgatgcttcccattgtctttctaaacagaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcagggcacagtgctccccaagcacctgctgcctgtctccaaatcttgccctgggtcttcaggagcagatcatcctactctccccaaagagcaggcgccagagaaagccaaagtcacaatgtctgtgaggatctcgagcaactcctccccatggcagtaggaatgcatgtagaaattcactctgttaagacctggaagagtttagcagttttagttcctaaaacttaactaccggttttcttctacacaggtgtctcaaagaattctaattgtcttaggaagaatcggtggattttaacgaattgtgatacagatatttatataaaaagtcatctttcagtgcagtggtccccaacatttttggcatcagggaccggttttgttgaagacaatttttccacggagagggtggggtgatggtttcgggatgaaactgtttacctcagattatcaggaattagttagattatcttaaggagcgagcagcctagatccctcgcatgcgcggttcgcaatagggttcgggctcctatgagaatctaatgccactgctgatctcacaggaggcggagctctggcagtaatgctcacctgccgctcacttcctgctctgcggccaggttcctaacaggccacagaatggtacagattccctgccgccaggggtttgggacccctgtttgggtggtagcagaggtttccaagcagtttctttaaggttttagctcaattgtattgcggaagatttgaaaattaaacatttttcattatgtacacaaaacttaaaagaagtttacgaccaactccctgaagagtcacctctgtagaactcatctgcttcaatgcaacgcagtccaacatagcataaagattatgcaggcggtaaccacctttccagagaactgagtgaaaagagctctttttaaaatgaggagtttagacgaaactggaaggtgacccatgaagagatttaggcatggtctctttttcactcttccaactgcaattatattcgccaagcccagatgaagctgatgattcaagttccgttagccatgttcattggtctaactacggggaaaagtcagccatagatttcaaagtgtgttcactgacttgaccaattactttatttctcagtacttacaaagatttttatcttgggaaagagaggataaaaatacaactgtattggagagtttaaacattaaaatcaactgagattggtcagctaaatggtcaaataaagtttttgcacctttttaataaaaagttttgtagccataaaattattgtgatgaaaattttgtaacataggaattaagttaatttatcaaatgaacaaagtcaaatacaaaatagtactatgccacttataaaacaaaataacatatgtatatagaaaaatatggatgggagcacacgcatgtttaggttaatttctaagagcaccgtaattatttagtagttgttttcatccattataacatttccaaggctatttcagagttgtgccaaaaacagttatgttaaaattattgtaaaaattattttctcctcttctgtcatagccttggcccttttgcacacggatcctctcaaactgacctttttttcgggggaggggaggggaaggtgggtctttctcccacaaagttttccttcctttctctttttttctttcatacgttttctgtgtttttctgctacaatcatgccaaagtacaaaataatactaattaacaaaatcacaagcactagaaaacagacatgaattataaaaggcctcataaataattctggaaagatcaaaaagtgacctttacagccagtaggggagtgaattcatccatcaaaacagctgccagagatgattcacatcagaagtaaaaaaacaaaaaacaaaaaacaaaaaccacaaacaccaccttaccagtataattaggatctcgttttgattctttaccaaatttaaggagagtatggtctgatatttcttggtttccctcactgattgtttctcttttcttcccagtgtatcttttattaagcacacatgaggggctgtcatcctttgattctccaatattttctgtctgggagaccccatgtacagaaacaaggggtggactgacagtttcaatttgactctagtgtcaaattgaagtgtttggctacttcctccaaaatctttcttcataggattttttttttgaaggttttctcaaagactacacctaactactgtacaaaaacacatcagtagagtctgcttaaaagacctccttcaaggtttcagtgagcatagatcgcaccactgcactccagcctgggtgacagagtgagactccatctcaaaatataaaatgaaataaaataaaaataaaaataaaaataaaataaaagacctccttcagaaggcattaatcatgtctttcttcctttttatctctctttctttccttccttccttccttcctttcttttttttctttctttttttttgtcacatccaatctgtatctccatgctgtctagagtgattagagtgattctctatcctttacagcaatggggcgcattagtccacatctctgtttttcttgctcactcacaggagataagattaaaaacaggtaaggataatattgttttatgaagcaggtattataatttcaaacttataaagaaagaaattgaaacctcaagatattaagtaacttacatctactcacttataagaatggataaagttcaaatatatgagaatatcagtactggttaggctacacatcagctggaactctcatacattgctgataggaaagagaaatgatcagcactttgtaaaacaggttggcagttcttacaaagttaaacttcacttacaatatgattcatcaatccctctcctacgtatttagccaagagaaataaaagttatgttcgcataaaaatttccatgtgaatgtttacagaagcttaattcataattactaaaacctgggaacgatcagatgtccttcacctggagaatggttaaacacattgtggttcatccatatgattgagtactactcagcaacaaaaagaaatgaaatattgactcatgcaacaacatggatgaatcttcaacgtgtcttggtaaataaaagaaactaagtctaaaggactacatattgtgtgagtttatttatattattaatacatatgggtagaagcaaaactataaagataggaaacagatcaaagggttggtgagaactgtaccatagacctgtataccgcaaaaagtaaatcttactgtgtataaattttttaataattagaatgtgagtggaaccccaaaagaaatagaaagtgtaacaaatgcttccaacaatattatagtgaataatgtaaacacagtgacactgtctttaatgtggaagaaaataactaacctaaataatttttgaaaacagtattttgaatagatattgtaagactaaaggcaaaagaatggcacacaaataccattctgtagttaataaatttgtttctcaaggggtataggctagcaattcttaaagtaatttatgtgagcatttggattgaacaaatgtgtataagtaaaatatataatagatcatagatcatgagagccagatttctcactgttgggaaaagtaataaataatgaagggagaaatctatgcagacccagtggagttgaactcatatttttttaaacattcatacatataggttgatacataaataaaattattaggagacttgagtgctttctgatgcccaacagcaaaggacaagcctgtggttactttattcaaattgattcaaaagcctgaaagactttcagcaaagtagataagaaatgtctgggaaacctaggtggtcttaatattaggaaagataacagaatttgtgttgtcaccatatttagttctgtcagcgtatctctttggtttttgtattgaggtataatatgcatatagtaaagtgcatgaacattcatcaaatgtttgtgaacgttttagttatgcacttacctgtgtaataatcctccaccaatcaagatgcagaatatttccaccaacccagaaattatttcattcctcttttcaatcaatacccacctctagagataaccactattttgatttctattgccttagattagttttgctttctcttgaatttcatattaatgaaatcatgcattacattttatatgtttcttatgttgaatactgttccattgtatgaatatgtcatcttgtttatctacttctctggtaatagaaatttgtgttgtttccagtttggggctatgatgaatacaactgctataaatgttcttatgtaagtctttttgtggacatgtgaaattgttgaaccttcttatataacttttattgttgtagtagaatctctgggtcataggacaggcgtatctttaaccttattagaaacttccaaggcatttttgaggttatatcattatggaaaggagtttcaattctccataaccttgctagtacttaatattgttgacatgtatttttaaactttttaattttgagattattataaattcacatatattttaaaaaattaagacagatcatatgtatcctttactcagtttactccagtggtgtaaaactatagtacaatatcacaaccaggatattgacgttgactcagtcaaggcacagaacatttctatcaccgcgaggatgctttctattgtccttttgtagccatattcatttcctctctgctcccatcccctccttcatccctaggaactattaatctgtccttcatttgtataattttgtaattccatatatgttatataaatgacctttggggattgactttttaaactcagcataccgctgtattttgtgtcttgccaaactcgagaagtttttggcttttacttctttgatactttttcagccctgccccttttcctttttagtgctctgatgaaaggaatgttagatattttgttatagtcctgcaattccctgaggcttggttcatttttttaatcattctattttccctttgttattcagattgagtaatttcttctgttctaccttccagttcactaataattttctctgtccactccattttgctattgagcccatctggtggactttctatttcagctacatttttaagttctaaaatttccattttatatcttggttcttttttatgtatcttacttctttgctgagatttctatttccacctgaagctttctgtttctttatttgtttccagcatgtctgtagttgcccttcgaaacattttcatcatggctgctttaatatctttgtcaggtaattttaccatcgctttcatctcagggttggcatctattgatcgtctctttaaaattctgtttgagatcttcttggttctgagtatattgagtgattttttttattgaaatctgaacatttgagtattgtgtttgaaactctggatcttatttaaaatttttgtttttcctccttttctctgatgccactccagcaggggaaggggaacaccgccttactacctggtagagatagaatccagggtccccattcagcctcattgacatcagagggcagggaggatcgtcaaactgccaggtgggggttggacttctgggtccctatgtacagatgagtcttgaaaaacatgagggtttggggcaccaacccccaagcattcaaaaatttgtatacaacttttggctcccccaaaacttaactactgataacctactgttgactagaagccttactgataacataaaaaatcaattaacacatattttatatgttatatgtactatataccacattcttacaataaagtaaactagagaaaagtaaatgattttaagagaatcataagaaagaaaaaaatatgtttacagtaccatactgtatatagcagttctgtaagtttatgtagtctgttcacaagatgaatcatctgtctgaaattgcaggcaactccaattgcagctgcagcttaatatcaagcaataaagttttttcttgtaaggtcatgacttttctctgcttcttgggcgcacttccagcatcactagtggaattttgtatggattccatggtgttattcaaggtttacactattgcactaaacacagcaaaaagtatgggagatcggtgagagatgactttttactgcaatgcgcaaatggctagagagatgaactgctcatgtggagagaattagcattgcattttaagtaggtattcacaaacttgagctcactgcaacagcaacagaaggtggctacaaaattattacagtagtatagtatgtactatagttaattttatgcagttgtgatttaatactgcatctttaagtttgtttgcatttctctggactccaagtgccgccacatacactctgtgtttatgtgcttaagttttgatacatttaaaatttttataataaatttgtgtatgttttatggtagtaagtgataaaatagactagtatttacatgcattttacacattcatgacatatctttttcttaattttattgatatttttagactacgttgtgtgtttgcaagtttttttcaactttttgcaaatctccaaaaatttttccaatatatttattgaaaaaaagttcgcatataggtggacccatacaggtcaaacttgttcaagggtcaactgtagtctccactgtaatttatttttctttctttatggttagggttttttgtgcacttttaaagatattgctgtccacttctaatataatacagttgttctcctgtgtcttcttttaaaactttatagcttcacccttcacatttagatgtctgacccatctggaatgtgtgtgtgtgtgtgtgtctgtgtctgtgtgtgtgtgtgtctgtgtgtgtctgtgtgtgtgtgtttatatatgattaaacaattactttggcatctatattgaaaagaccatttcttccccactgaactgcattggcacctttggagaaaatcaagtgattacatatgtgttcatctatttctgggcatgattctgttaaatcatctttttaacaattctcataccaatagaccattttctcttaattattgaagtttcacataagtcttgaaatctggaaatgcaattcctccaactatcccccacctttttcttcaagattgtctagcttgctataggatttaaatttccatagaaattgcaaaacagattctcaaacttctaccacaacaaatttctagtaatttgattcaaatttgctgagtttatgatcaggttgagaaaattgataatttaaatatggattccttagatttataaatatagctcttcatttatttaggtcctctctaattccttttattaatgttttataattttcattttaatgaactttcatatccttaattaaattcattcatttatttcattgtaaatggcatttttattttattttccaattgtttttagctagaatctagaaatacaatggaattttttattcaatgactgtgcaattcatccattagttctagtagtttctttacagatccttttaaatttttttatattcaaattatgttatctatgcagaagaagaattttacttattcctttcccaaatgtatgcattttattttctttcctgacttgatgccagttattccaatgcgataataaatggaagtgtgataatgtatcttgttcctaacctcagagaaaaaatgtttagtattttaccattaattacaatgttagccttggatatttttatagataccttttatcagattaaggactcttttctacatttctagattgttgagagtattcatcatgtgagggtattggccttgtatcaaattctcttgtgtgtgtaagttttgataaatttaaacttttaataatagatttgtatatattttatggtggtaaatcataaagaagttaaaataagttgaactcattattttggtttttcatcaagcaaaggaggagaaaaccttacccattatgatcttagagatcatgtaatcttctaaaatgtaagatactctgcgaatactcagtagattggacaaatacattttttattctttagagctatgcaaaatacttaatggtttttcaataccattaaaaaatcacctgttagtggcctcaattgtcttccaaaaaataaaggcgaacaaaccaaaagcaaaaaaggaaattgcattaattacttttcttctgcctttgttaatgtaacaacatgatatagtcctccctactttcagtaattgcttgtttcttcttatattttcggcagtactgtcctgttaacttacatctttgtgatctggtacagagtaggctcttagtgaatattttttaaatgaatggaatattattactatgacttttactctatatctttgtagcttgatttttcacacccgtgttggggaaatttattgtctatcattgaatttttgcctacaaatctgaccctgtgtttaccccattgtagtcttttgttcaaattctattccagaaaactgaaagagtgcacagacaataatttaaagatttgctcagcataagttctctcagtaaatttgtcagttatgactcatctacgcattcatgaaacaagtaattattgagtgcttattctgtgccaatatctcttttttttttttttttttgagacagagtcttgctctgtcgcccaggctggagtgcaatggcacaatctcagctcactgcaacctccgcctcccgggttcaagcaattctcctgcctcagcctcccaagtagctgggacaacaggcacttgccaccatgcccggctaattttttgtatttttagtagagacagggtttcaccgtgttagccaggatggtctcaatctcctgacctcatgatccgcccgcctcggcctcccaaagtgctgggattacaggcgtgagccaccatgcccggccgccaatatctcttataaacattgaatagtatgggcttttgaactagcctttaattatgggaatattagaaacaaaagaaaaattaactccaagtcagcaattgagaattataatgggaatattattgaaataacaaagtaatttaaaaaatagttaaaacctttcttggagtgttagaggactgataaaacaaagatgagtacagaggtattaaaactaagatacctaccttcaaacctgataaaagagtcagaagattgctggctgactttttgcctgattatagctacacagttcattcagtcagtcagtcacaagagggggctgcttcaccttaaaactcaggtttctttcttgcagaagggacgctaagcttatgttttccactaaagttccacagaaaacaggaaaaaaaatgatacacttttatcctctttagacaaattgtactttatgatctcttattaagtgtgttatggcttcaaaagttctggggcccttacactgatggactaagtcttttcagagcacctcccttaacactgctttctccaagtttcacttccctaatcatctcttacctcccctattccttacacctttttcttcctttcctttacctattcttaccaccgtcaccccaaacttctttgcttttcctggtctcttttctttccgcctcagtgtccttggtgcacacagtaggcataagcacgggcatagaaattaggaaatgaacatgaaggccatgagtttaaggaggatgagagccagcaccatttatgtcattagtcactatatcaagaacagatatattgagaaatggctacttagacaacagtcaacacatgattccagggacctctatagaaaacccgagtttggggagacttagctttcagtgtcaatgttatcaatttttattttccccctgagcacatcacttcctacttttgaacttcacttccgttttctagaatgtagatgggaatttccaactccttacaacacagagctcactataggcttctgggatttaatgacactttccacaagctccatggagcagaggaaactttatttggtacattgaggaagaaatgatggaagaaaaggtctggatagatacatccttatgatcagttttcctcattctgtgccagcctcttagactttaaacctcataaatgatttcagtagacaccccctgagttgaggatgtctggttgatatcctcaccgtcttctcaggaacatgactaaacctggggaggaagacatagaaaagcaactgctctatcattggctgacaagatcctgacaacaacacaatgagagctgcactccttgcaagtctttactagtagctgttgcttctgttctctggaaattctttaaacctagaatcagacacaaaaactgaactctgggtccacaatcctcatttgtccttgaagtatgaggctggtggcaagagtaactgtgtttctgacctttggtaagtgctctgtgtctacctagggagggcttctgaggacaagggaccccgaagggtggtttgccctctatgctccctgtgctttatccagcatactagatatgactgagaactgttctgtgcatttgtctaggaagtacatacatctacataccaggctagatcataaccataatcccagaagagcccttggcagtattcagttttaagaaatctatgggtttactaaatcaagctcccatggaatacagcctagagggtctctgattattggcatgtatctttggtctttataattaacagcaatgatattttttgtgttcttgcaggacataaaagttttggagtgttaagggagtgttgtatccttgatccatagaattgcattggtttgagagtcaggagctaatctgattttcttgaccccttaggaactataattgatgctaagaccacccagcccacctccatggattgcgctgaaggaagagctgcaaacctgccttgtaatcactctaccatcagtggaaatgagtatgtgtattggtatcgacagattcactcccaggggccacagtatatcattcatggtctaaaaaacaatgaaaccaatgaaatggcctctctgatcatcacagaagacagaaagtccagcaccttgatcctgccccacgctacgctgagagacactgctgtgtactattgcatcgtcagagtcgcacactgggacagatggggctgcacctgtgcaatatctccctggtggcaagtgaggaggagggtagcattcacctagagcaaaatgtcgataggagtcaaaaagtaacaagaaaagaggaaaaggaagggaaggagagaaggaggaaaataggtaaagtaaataagggagatacgatgaagggtaaaaagataagaataagaactttattgttgatgcggctgagaaaaatgataaagaggctgtgaatcataatttgaacatagcaataaaatgaagagggttaagaattttcaagactcttcttcatgtcaaaaaaaaatcatttcagtttgttagtaaaaatgaatggataaggaaaatcaaaataattctgcttgtcccaaaggcttttttcgtctggatccaggggcaagtccaagctttgaaatgcatgctgttatagttgttccaattaccagaaacaagttgatgtttctgcaagaaaaatctgaaatgttctttcttactagtgcagtaacatcagttactagagcatgcatatttgtgatgaaggtttttctttttggaaagaaacaaaaatcaaatgaatattaatttgtttttatttttcttgaagtcttgaatctttaaatagtcttcatcacgttttatttcctaagcagcacacaaatccatcttaccataaaagactcagataaagcaaaagtgaaagacctagctgcatttcctcattcttccctatctcacaacactcttttcaaagaacactagctttgacagtttaaggtataccatgatagccagtttaatttcagttatctatgtttgcatataactttatgcaatcacacacaaacttacatacatacacacagttttgtcatgtaaattggatttattagattttttaacttgccatttatttttcatttaataaattgtcctagagatctttctatatcaatagagaagttcactttattctttttggtgcttatttagtactttgagacattccatcatataattgcttttctcttgatgcatatttgttcctattgcctcactgtcataaagaacattgtgttctacatctttacagattcaccttagtttgtgtgtatgtggaagtgtttattttaatgagatttctgaaactgaaattactatgtcaaagggaagttgcatttaaaatttttggagaaagtggcaatttgccctccaaaggatgtaactacactccatataatacatatatatgtattattatacacataatgtatccattataactattatataattaataaatataatacatataatgtgttaaatagcttccaaccaacagtaggtgaaagaactcattttacatttttataaaaattgaattgagaattactaacggcttttatttttattttacttaattattctatttatttattttgagtctgggtctcactcttgtcacccaggctggagtgcagtggccggatctcggttcactgcaaccttcacctccaaaactcaagcaatcctcccacctcagcctcctgactagctgggactacaggtacacaccatcactcctggctactttttgtagagacaggatcttgccatgttgcccagtctggtctcaaactcctgagctcaagagatctgccagccttggcctctcagagtgctgggattataggtgtgagccaccgcacccagcccagtttttaataatccaaagatatattatctttagtcattttcctgattcatagtgtttttgagcaacttttttctacatgtattggcactttttcatttggcaatatgcttattcctaccttttgaatatttttctatttagttgtcctcttttctctttttattcgtaagaattagtttcatgccttaaataatacattatttgtatgaatattttattctaacattacctttttattgcttatttctaatataattttaaatttttacatattttaacctatcaagtattcctttcctttaggccttgaaggtcaatatctttacaggaaatccctaagtatatcacatattttaatatttattaccatttggttgagaattattttgagatgtatgttacagattagaaaactgagtctcaaagagatttaaaaacctgctaatattcacagtattaataagtgagcatcaagtttaaatttatttttaaacctgagattgtctaacactaaaatctgaacacacattgtttaacctcatcttactggaagcaatcataagaagaaaaccccaaaataatgaatcaaataaagcatcagtggaatggattatagtagccatctaagacacatgttagagcaaaaggtccggaatgttagggtagaaattgcgagttatgagttgagaaagtcaatggtccttaatcttatagaaaggtaatgttagtaccccaaacattcaaatagcagccaaaatgggtgttttgattgtggaagaactctaacgcatcctcagctctttattagccatatgtttcccaggcagaatggatattgaagaaattagaacataaagcaaaggaagtaggaaagaggagtttgatcctggatctgagtggcttccaattattctaggaaacttcacacagattgaggaatttttctggtccatagaatgggtagataaatgtaaattactatgatgatcatacttggaaattgctttgattccatgagtgaaagataagggaacagatatctacacacaaatcttagaaagtgcactgagatgtgctggtagcagtttccaaagattgacatatcactttcaacgtccttacagtcactttattcacactccttttctctttcacacagtctttaatctcatttaccttttgtttaacaccatcctctactctcctgtatttgaacacacaaatgtttgaggcctgtatttttggtttttattcactgaagcatcctctgtatctaggacagtgcctggcaaatagtaagtacttagaaaatatttactgaacaaatatatttatttataattgaaaatttttactggcaaatactaaggatgcaataaaatactagggacatgagttagattcgctatgaggatacatgagccattcagtgagaagcccgaactcatcaactttaaagaccattaatttgaatcccctttagccattaactcccatagccaccatctagacaggtcttatgataatgttctgctccacctctgaaatcttacctgcagtctaaaacctcccaccctgagattctcaccctcagttactctcactgtacttgttctttgactatatttggttatttagtcccttgacacctttcttttcttttttttttttttatttaacttttgttttaagttcaggggtattgaacttaaaataggtttgttatacaggtaaacttgtgtaggtttgttatataggtaattctgtgtcatgggggtttcttatacagattattttgtcatccaggcattaaacctagtacttatttgttatttttcctgatcctattcctgctcccaccctccaccctcaagtaggccccagtgtgtgtttttccctctttgtgtccatgagttctcatcacttcattcccacttataaaagagaatgtgcagtatttggttttctgttcctgtgttagtttgctgagaataatggcctccagttccacccatgttcctgtaaaggacataatctcatttctttttatggctgtgtaggattccatggtgtatatattaccacattttctttatccagtctttgatgggcatttaggtcgattccatgtctttgctattgtgcacagtgctgcactgaacatacacatccatgtgtctttatgatagaatgacttatattcctttgagtatatacccagaaatggtattgctgggtcaaatggtatttctgtttttcaatcttcaaggaattggcatactgtcttccacagtggttgaactaatttacattcccaccaacagtatataagtgttcctttttctctgcaacattgctagcatctgttgttttttgactttttactcatagccattctgactggtgtgagatggaatctctttgtggttttattttgcatttctctaacgatcagtgaagttgagctttttttcgtattattgttgactgcatgtataagacatacatgtaagacatacatgcagccaacaataataacttcttttgaaaagtgtctgttcgtgtcctttgctcactttttgttggggttttttcttcttgtaaatttgtttaagttccttatagatgctgaatattagacttttgtctgatgcatagttcgcaaacattttcttccattctgtaggttgtctgttcactctgtagatagtttcttttgctgtttagaagctgtttagtttaattagatcccatttgtcaatttttgcttttgttgcaattgcatttagtgtcttcgtcatgaaatttttgcccatttctatgtccagaatggtattgctaagttgtcttctaaggtttttatacttttgggttttacatttaagtctttaatccatcttgacttagtttttgtagacagtgtaaggaaggggtcccatttcaatcttctgatttgtctagtcagttatcccaacaccatttgttgaatagggaatcctttccccattgcttgtttttgtcagctttgtcaaagatcagatagttgtagatgggcagccttattcctgagttccctattctgttccattggtctatgtgtatatttttgtaccagtgccatgctgttttggttactgtagccttgtagtatagtttgaaggtggggcatatgatgcctccagctttgttcccctttattttcaccttatttctcagaagcttcttatcttttattttcttacctataatgcttatactctattacctgttgctttcaatctttagtcattgactatattattctcatcccaattctgcatcatagcagtgatctaattaattcccaatcatgaatctgtatcttccttattgtaatgcatatcttgtctgatcagagtacaccgatgcgcagattggtgtcattaaaacatactgttaccagccgggagcaggggctcatgcttgtaatcccagcactttgggaggccaaggtgggtggatcacttgaggccaggaatttgagaccagccaggccaacacagcaaaaccctgtctctactaaaaatacaaaaaaattagccgggcatggtggcacacatctgtaatcccagctattcgggaggctgaggcaggagaattgcttgaacctggaagacagaggttgcagtgagctgagatcatgccactgcactccagcctagacaacagagtgtgactctgtctcaaataaataaataaataaataaataaataaataaataaatgttgttaccttcaaaattaactaggcccacaatgtttccaggaaagtattcttctctgtaatcacatctcactgccattttctaaaacttctcacatacctcagacttcctaacccagatcctcctccattcactctcttgggagacatttaatctctgtgtataacaagaaaaaaaatcccattagaaggtaataggtgtttcactttctaccttcacactccaaagtatcacttaaatctaaactactgtaatccttttctccttcatttcaataaaattgaaaataactgtttttcctcctaccaaaactttgtccttctacccataatccacattccaatcccatctgtctcctcaaaactttgatccattgtttatacattctttccaaaagcatgtaaatataccctaatttgtataaaccctaccattacctcttcaacatcctcatccagttaacaccatgactcttttctcctctttagaggatccagcaacctctagaaggagatttctatattcaaattttttcttccttgtctcatcacaatgcctcttcccatagcagttgaccttttgctgaaaagaccaaaatcatgatttttgtgttgttaaaaaaatcagtagttcagtagcacagtatggtgactatagttatcaataatttattgtatatttcaaaatagctagatttggaatgttgtcaacacaaggaaataataaatgtttgaagcaatggttaactcaattaccatgatttgataattacatgttgtatgtatgtatcaaaatgtcacatgcatttcataaatatgtacaattattacgcatcaataaaaaatcaatagacattgaaaagttatcatcttatagacatttatttaccactcactctgttagccattcatttctttttagaattcctttttccttctcttttagaaatccagccatttctgatttgccacttacctctctggataccctttgaggtttccttttctttttcttttttttttttctgagatggagtctcactctgtcacccaggctggagtgcagtggcacgatattggctcactacaacctccgcctcccaggttcaagcgattctcatgtcccagcctcccaagtaactgggactacaggcacaagccaccatgcccagctaattatttgtatttttagtagagatgggatttcaccatgttgaccaggctggtcttgacttcctggcctcagatgatcttcccacctcagcctcccaaagggctggaattacaggcgtgagccaccacgcccagcttcaaggtttctttagtactttttccactatctatcccatcagtgtttgggttccttgaggatttttttaagtccctattctcttctaaattttgctctaagcatttgtcttggtaaaattgcatctagtcttatagggtagtactacgtcacagataacatagtgggcaaggaactgagcttgcagtggaaaagaattggattctaatccttgcatgtccttggacaaatgacttaacttcataaggacttgatttcccgtctgttcagtatagataagatctactgtaaagggctatagtgtaaaatgtgcaatagttatcagtggtcaataatgtggattattaaatcatattgatgagacaaactccaattctgttgagatagcagatcagccagacttgttttctgagcactggtcacaagaccctgctgaacaaaacaggagctgatcaaaacagaatgcagcaaagagagtggccaaaaccagctaaaaccaagatggagatgaaagtgacctctgattggccccactgctcattatacactaattataatacatttgcatgctaagtgaaactcccaccaccaccatgacagtttacaaatgccatgacaatccccagaagttaccttatatggcttaaaaggggaggaaccctcagtttagggttccttttccaggtaattcatgaatttatttattatttagaatataatcaaaaaatagccatatatatagctagccaacaatccacaagggctgtaactgctgctgctattactctgtctatggagcaaccactttcctgtactctgtagctccaatacacttgccttcactttgctctgtcagctcactcatgaattctttcctgtgtgaagccaggaaacctgctgggctggttttggggatcacctacctcactatcacttactatgacttggacaaattgaatcttttcttccatgctttagtttccccgtttataaaatgacgatgataatagtatttacttcataggattaaataatattatttactttataagattaaaatagcttcctcataagcagacccctgaaaacactgtcatcagattattctgctaagaaattcaaaccaaggaaatggagcccaaacccaaaagactcagtgtgtttccacatttgacctccagggggcaatgtctcacagaccggaaatgtctctgctaagaagagttctgtccttcctgagcggctttatctcacagctcactgaggtgcatattctgagtaggatcaacaccagagtggttgttgtcaagagagcagctcttactagtggtctctaggccttacctaagcagggaactcttgaatcccagattttcctcattatagggactcaccatcctctggcacattccttcccactcaggagatcttctagaatagagctctcagcttcctcactgcctagccatgctcttagtggtcattctgctgcttggaatgttcttcacactgagtaagtataataatattgtttccctgctcccgtctccatacaaggaacattgttccaatcggaatctaaatagagactctgtctcattacaggtagatctgttctggtctcactaacagagtgttgatgttgcaggaggaaccagaacccagtcggtgacccagcttgatggccacatcactgtctctgaagaagcccctctggaactgaagtgcaactattcctatagtggagttccttctctcttctggtatgtccaatactctagccaaagcctccagcttctcctcaaagacctaacaaaggccacccaggttaaaggcatcagaggttttgaggctgaatttaagaagagcgaaacctccttctacctgaggaaaccatcaacccatgtgagtgatgctgctgagtacttctgtgctgtgggtgacaggaggactgtgcctgggactgcaggaggagctgaacacaaacttcctgagacactgaggttttcaggaactcaagggcacagcctgacctatttgtagcaaggtctctcatttgatgaaagtgagaaaggtggaagaacagagccatgaggagtgcttgactccagagaagaaacagagacttcatcacgttccttcttttactactgggtcacatcagacaagatgtggaagagacagacttctatgactgttctccttctgcttggaaataccacactgaagagggtcaagtttttttttattatactttaagttttagggtacatgtgcaagattttaaattagtgtgaccagtactggactcctgatcctctccttctcactgccaacatgctgcttctattaccttttgtttttcaatcgacagcatctcattctttcagaatctgcccatagcctcagagttatttttgactcttattttttctttcactattcacattgaatccatcaagaaattcagttggccctaactaaaagatcgacccatagtttgaccactgctatctctttggtcaagccaccctcatctcaatgaattaccgtagtagccttccaaatggtttccctgcttgtcctcctacagaacattcttaatacagcagccaatgagatctttcaaatatagataggtcactcatctactccaatccttgcaatagcttcccatttctcttagagtaacatcaaagtacttacagtgacctagaggaatgcatgatgtatctctcgttacatttttaaaacaccaacagaaaaataactttggcaaccctgaattctataccagtaaaaatatcacaaagaaattatagtaaagacattctcgaaaggaaaactgagagaattcgttgtgagcagacctgctataaacgaagtcctaaaggaagttattcaggctgaagggaaaggataccagaggaaaatttgcaacttcaaatacgaaggaagaacaacagaaatagtaaatagatgataagatacaagaaactagtttccatttctcttttacagtcagctttactgaggtataagttatatacaaaaactatacatatttaatatatgcaatttgatgagtttggacatatgcatacaaccgtgaaaccatcatcacaatcaaggcaatagacatgtttgtcacctctaaaagtttccttgtgactctttgtttttgttgttattgctgctgctattgttgtaagaaaaattaacatgagatttaccctcaataaattttcaagtgctcaagcctgtattgttaactatggacactatgttgtatagcagatctttagaacttatttttacataactaaaactttaaaaccattgaacaacaactcccaatttctccctccccccagtccctggaaaccattattttattctctgcttctatgaatttgactattttagatacctcaaataagtgtaatcatgcattatttgttcatctgtgactgggttatttcacctagcataatctcctccaagttcaatcgtgttgtcacaaatggcaggatattcttctttttcaaggccgagtaatgtttaattgtatgaatataccacaatttatttatttatttgtcactaatctttcttttccatatcttgcatattgtaataccacatgcagaagaataaaattgaacaccatacgcaaaaacttactcaaaattaattaaagacttaaacatgatacctgaaagtgtgaaactactagatgaacacgtagagaaaaagcttcataatattggacatgacagtgatttattgggcatgacaccaaaagcacagacaacaaaagcaaaaaaagacccatgatattacatcaaactaaaaagcttctgtgcagcaatggagcaatttatggaaagggagaaatatttgcaaaccatatattgataagtggctaatatacaaaatatgcaaggaaccataaaactcagtaacaaaaaaaaacaagtttaaaatgggcaaaagactcaaatagacatttctcccaagaagacagacaaatagtgaacaagtatatgaaaaggtattcagtatcactaatcatcagggaaatgcaaatcaaaaccacaatgagatatcacctcacaaatgttaagatgaccattattttttaaaaagttaagtataggtgaggctgtggcaaaactgaaatccttgtacagtgtacagtgttcttgggaatgtaaaatggtgtagctgctatagaaaacattatggagttcctcaaaaaattttaaatagaactaccatataatccccaaaccctacctctgggtatatatccaagataattgaaatcaggatctcaaatagatatctgtattcccatgttaatttaagcattatacacaataatttctcttcttaatttatttaaaatgcatagactgttgaaataaaatgttataaaattccccgttggggttttcaaagtctaaagatggaaggcatctgagaactataacatgaagaaatgagggtaaagtaacctatatacaatttctatattgttcatgaagcagtataaataaatataaacagactgtgaaagattaagtagtaagcatagtagtagtaggcaatcctaatagaaaccactaaaaacataatacaaaaagaaatagtcaaaaatcaaatagatacattataacagaataataagagaccaaaacaaagggcagaagtggaaaatgaatactgaagtaatagacttaaatacaaccatattaatagttacattaaatgtaaatggtctaaacacagatatttaaagacagagattatcagtatggatttttttcttaaagaagacccatctacatatgaactgactttaaatacaatgacaaagattaaaagtaaaagaatggaaaaagagatccatgaaaacactaatcaaaagaaatctggaagggctatattaacatcagacaaatgggacttcagaaaaagaaatattaaagaaataaagtgaaatattacataattataaaagggttgcttcactaaaaaaatgtttaaagtgcttgtacctaccaacaaagcttcaaaatatttgaagctaaaatggttagaactaaaagaaaaatagacaaaaccgctattacacttggagacttaaaccctttgtgttcagtaaataatagaacaagtgttatagttagagaatcagcaaagatgcagcagacctgctcaacactattatattgacatttatggaacactccagtaaacaacagaaagaacataaagccatgcttagaagaaaatttataacagtaaacatttacattagaaaaagaaaaaaggctcaaatcaataattttatttcttccttctgtgtgtccccagtgatgatgtcctgcacagaaaaaaataatcctagcaatccaagaaactctgtttttgagttcaggcaaagaagagtattttctgctgttactgcaccaggtacccaactggaaaatgatatgtctcatattttatattgctctcctatgctcaaagattaaaatgagattaattctatttatatcacatgtcacagttctggaggaggttatgagccttcctattatagtaatgatatcagaaagggtacaagataagtttagtccttcatcttttaaaaaaatatatcagttatgaagattgttcgccacgaaatgaattccgttatatacattataaattatataggacattatagggtaccttacaatacatctgcgtattttcacacaaggtgagatatcactaattattaaatggaactatgccactatgtttttccttagcttttcaagggataagcacaagaatattcaagttatgcagtgggtcaagcctaagaacaaatgggaaagctgatagaataaagaaagactcaggctaggttctggactagctgggactaacatataataagtccataagtgcagaatgaactggatgtgaggagtgtgtaacccttctccatttcaacgtgcccaccttttgctttatttttcgctgaatgcctctcaatataacaatgtaacaacacactgacatctcatttaagtgtcagaagcattatggtacatgatagagggaacaatcagcttttctgtgtcctatttgatctttgacagtataaaaatctgacttttttcctgtgggcaggtatagagggcgtatatgataattttgtgtactttctgctcaatttttctgtaaacataaaactgctctaaaatagtctattaactttgaaaaatcaattttagtatagaagctaaaaagaaaaaagaaaaatcaatccaatgcgctcaatctcatagaaaatatttgctacaaccagttcggattatttcttactttcctgccttgtgtactctcttcaactttttgtgttggtgcttctttggtttgtgtatttactatgcagcatgcattatgtaaagttttgcatatattatataatttaagtatactaacatgaaagtagaaataacttctgttaggaaaagaaatataataagtaatttaaaagaaaaagtttatggattggatagggtgtgtagaactctcaactctgtcattatttgaattatagtagaaacgttaacaaacatcttaaatttcaattttatcatctgcttacaggagatcatcatgatcatcctgtcggcagttgttccaattatcgaataataaaatatctttcaagggcttagctcatattctagcacaatgtaaacatttaataaattattataggtaaagaaatggaggcccagaaaacataactaattttgctcataatcagaaacctagtgcattagagaaagaacactgagttttgaaatcctagctataaaatttaagccaaatatcttcaacttatgatatcactgatctattctcttgaatacatatattggaagtaaaagatgagcagctagagaaaagtagaggaaaagagagaaaccaggggaagcactttgaaaccaccaaacatgtattatctcttcagatattcaatcacacagataggcatactccttgatggccatttgtactagggctgcaggacttgataaaagagaacctacaacaacattctgtaaccttcaattgatttgttgccctagatctggtccgcatctctctacaaggttataaatgtaatgttgttttcagctgtttctccttgtattaatgaaatggaaaatcctttctcttctgtcctgacacagccctgattattaactggagtcacaatatttttctttctattgttatacaaactgtgtggaaagtattctctttattctcaagactatgatttaatccagttagtaagagggaagatcaagatagttagcttgatttttccattattcagtagatgggcctttatataaatgaagcgggagactggcagtttactcctatactgtgtgagcttcctttcattaagacctcggtgtcttacagcttctcatgactcttctctctcccactgtcaccttctatagcagcaggctctttcctggcagatcttaatgtgggaattaaaaaaggattgatgtgtccacatattaccacagacagattgatagggtcaggctagaaagaactatgtagaaaaactcggcgatagaagcaaaaggcagaatgggatgtacagctgagccagaaaatacaaggcaagaaaagataacagagatcgaatgcccataaatgtccttatttctgtgctagggctctgtgactgcaggtacaacagagaacacatgagatcctaaggaaagagtgtatgtacgggcgttggaggcctgtgagtaccatcagaacttcctgagtttcttccaaatgtcctttcttcagtaggtatatctctgaagcacctgtgtgttgaatgaagaattacctaaagggctgaatctttctcttcttaccttttctctagtcagtgccagactttagggcatgtgtcctctgggatcacagacctcattgaaaacaaatcccagtatcccagtatggcttccattctagtgggaatgggaaggcaggcccccgttgtgctcctctcctggggatgaatgttcactgaggttctgcagtacctctatgccatggctctcctttagtcctggaaacagcattcagactccagtccgtcatagcagtcactcaggatcttacagccagctcagcaacaaacaaaaacatagtctggggctcatagcatcccttccaaagactagattttctgatttcaggtacaagattcttgtgacaaatgacagaaacaatttgtcaattcttccgaacagaaggtccagcaacctgaacctcccagggtggaccagagagatgctgttgtatatgactatgctctgagagggatgagagtgacaaatgaggctgctaccgtgtgatagccctatgacaaaaatgaaaaggatggcagccttggaagccagttgaaggaaacatacataaaacacactagcaagaacagaatgcttactctttctttttgataagaaagcccatctgtcatatgcttccttggtctagggaccaggttacaataataatgatgataatgatattaaaatatatcatttaatatcattttcattagtaataaataaaaaagatcaagtaagtaagcacgaaattcaagtaattagaagaaagaaataaatctaaggaaatcatgaaaatggtacagataaatgtataagcataactaaattatgagaaaaaagaaaaaatagaattggacaattttttaaaaattgaatcatgaaaaaattagattaactcttcttttattgaagtaattattcaaaaaagagagaacctatgtaataggtattatacaggtgtatagatacatttatatatacattatatagttttctatcactttgttatcttaatttatgttttagtcctccgtgtgtttcttcttccttcacctgttttcaagcaggtggtgtctctgtgcttcaacatgtaagtgatgatgcctgggaatacagaaagctgtgtttgcctgtagagtcttctggcttgttttgaaaaatctaatttctttcaggaataatagggtttatggaagtgggagaggtggaaggaggttttttggtataaatagaagagagaatggcttttccaggagagaataaaggggtctgtgcgtcctgggcagcagggaacaggtcgttgtttcttgacaactctctgagaattagtaagacccaagagtgggatggctgtttgataattagaaagagttcccaggcttgcaaaagattttggggactccataaacctgaaaaacagaaatcttccacttagaatacacacctaacatgaatagttcataacatattggataagaaggctatgtttgtgattccactcacagaccatagtgataccatttatagttaaattggcttgtgagaacgattactaggcaaagaatagaacttgtcttggttgtctttataatcacatacacaggtctgtctctttgaagcattagatctcaacagttcttaagtttggatattgggctgggacagatgaagaagacctggggatccctcagttcagctctcatggcttcacattggatgtgagcacagaggctgtcaaagacttttcccaacaggctaagggatagggcaaacagtcacgctcattgtggattactcagaattccctatgagaaaggcataaaaaggttgtaaattcggtagtaatcctgaatttacaatcttatgcagttctgcccatcaacagggagcagacttcgtgatctctgcacgctaaagggggaaagaagatcaaagcttcttttcatgctttaacaggtattagcaaaattctgagaaggattgccaatatcctgttcataatgaatctaaactggagtgaaaaggaagaggtaagagctctccttactaataaggaggcagagcttcctccacccttcagtcttccagcctgaggctcagccacctacctctgtgtgctatgttcttttggcacctgcagcctgtccccagtggtgctgctgggcttatggctcccagtgtcaaggcagcaaacttattctcaacaggtgtatagggaaaggcaaactcagtgaatcaaatatttttaatattctgaaaaaatgatctggaaatacaaacatataacatttaataaatattatttataaatcatatgaaccattatcaacttctcttcctctgcctcagccatgtcagtaactcagttattctctcttatgtcttggcattatatgatactcgagattattcaagtgtatgcattggcctatagtagttgcttttctgtttctatcccctaaatattggttatattatcttattttttgctcctacatgaatgggacctacaatataagcagtccccacttacacacacacttgtgcttaaatctcaataatctcctactagtgaatgcagtgcaggtctctttaatttatggttacttttttccagtttcttccatttcaacaatgtgcacattttggtttttgtgccacctcacaatttttctttcctgactctttgtttccttgagaggatcaggcaagaggaaactgacttctctcatctatccatacccactctgtgatcttagataggcttcttcctctatcatatggagacaattttacctactctacctcttacaggattattctgaattatcttccaaaatgaagatttctttgcatcaaataatatagaactaggaaagaattatatatatgatgagatgagcctcattgtatgggtgaagtaaaatgtggactatttctgaaatggattgtatattaaattgcaatctggttagaggtttaaatcactaaagaggtagttattcatataaaactgacttagagttgctttgataaattaatcaggaacacagaccagttaattaatttatagcacctgttaacatccaaagaaattaaacctttcttctcaaaattaagctctaaccgtttacactatagtcattttaagtattttaggattatgggccaggcgcggtggctcacatctataatcccaacactttgggaggctgaggcaggtggatcacctgaggtcaggagttcgagaccggcctggccaacatggcaaaaccctgtctctactaaaaaatacaaaaattagccaggcatggcagtgggcacctgtaatcccagctactcaggaggctgaggcaggagaatcgcttgaacctgggaggcggaggttgtagtgagctgagattgtgtcactgcactccagcctgggcaacaaagcaagagcccatctcaaaaaaaaaagaaaaaaagaaagaattttaggattatgtaaagctactaattggcttacagaaactgactaaaataggaggtcttttccttggaaggaaaagatgtaataatctcagttttggataaaattgggtagaacagatttccctacggtggttaaagggataaaaacacaagatatccccagcatctacattacagacttcaatgaaggaagtaaaaatatctcaatagttgagttgaggaagtgggtcaaggatatgaatatccacagatgctgacaagggaaatatatgttatattcataaaattcaagtaattaagataggtaagtatacatgtccacttaggttagatgttaattcttaataagtaacataatgatctgaggctctttgtgtgccacttctacatctcaaactttgacgtggatcccctggagatcttgttaaagtacagattatgattcagtagggtctgaaattctgcatttctaataagctccaaggtcatattgaagccgctattctgctgagcaaggtttccactatctgagaggcagtattccacaggacctaagtgggtccactctttagccacactgcctagattagaagactggctctgcccgcttactaactatatgactatgggaagattaatgaacttctctgtgtctcagtttcttcatttgaaaaatgagaataatgttaacttcctccagtgatgttgtgaagaataaatgtgttgatttatatgaagtgtttagaaaagtcaacaacattgttaattgtacatattgtttgtcaagcttgccatatcaaaaatatctatgtgtttttgactactaaatacctatgtgtttttgattggtatttaattggctacttgtgtactagttgtttaaaaagggacaaggtgactaattattgagttttatgtagttgttacacttcttcacataacgcttgtcacagaacaatatagtcatatattctgggcatttttcactcaggatgagtgtggctgatgaggctgatgtattcttggatttttctaggtgatgattcatctgggctgggcctttcattagggcctgttgagaaagaattgaagtagtaaagctgagcttcagggaatcctctaaatagattggttgaaacacagtctggtttatatacataatctcaatgaagcctcaacacatccttgtggcataagtaatataagccccattcaacttattagaaaactattacaggcgtgggttaagtaaattgtttgatgtgacctagccagtaaatggcaatgatggagtattaatataagtatgtctgaatccagtatcaagtcatttaggcagaattcatcacttctctacgaaaagtgttaagtgttaaaaatatttctgaaagttttctcttgtatccaaacatttttatattcagtattctatttgtcctggtgatcctgagctcccttgaggacattggtggcactaaggggaggcttacacagaactggtgccttgaactcagtttcccctcaccacccttatcacactggaggctacccagggtggactcagagtggaaggagaattgtccatgtggaccacaggctctcaccgtggaatgattctggaggacttgatagtgtggctagaggttctattttaagctctgagaaatgtggaaaatctcctggggaggtcaacagttgaccctggccctttcctctctggtgcaacctccaaagggctattctatttctctcgcttgtcactgagctctacttcatgtgtaaaggcaggttggatagtttccaaatctttgttgggatgcccctctaaaccttggataaagtctttccctgtggccccattgttagcagttattacatgtccaatgtttgcctgtaatgctgctacaggtcttttttgacacattagttttgaaaattgtttttgacagcagctcttttggacactaaggacctggaaggcagagaccttatcttgtctcatttatatcccccaaatctagtacatggcctgaaactgtgtttattaaatgaagaatgtgttggaaaattagattctggagaaaggcttgcttagaatattttaatcagaaatgaactttgtactttttcgcctatactcctacggagccacattttttctaattatataccaagaggaataatggtacagtttgagtgtgagtgtttttattttcttttttatatattgataacaaactttttttataatgggcatatttggggtagaatattttctttttaatatattgataaactttttttataatgggcacatttgggatagaatatacttctatcccaaatgaacatgaaacaagcaaaacatttcttcaataactgaccaaagatgatagggattccacttcaccttagaatatgaatagctaaatagtgtgacttaattgtgtcatatattatgaataacagagttcatgagaaaatgagctatattttcatatatttgacggagcagaatatggcagtgaaagagcaaaatctctttcatctggatattcatcatcccaaaccaaatcttcattaaacttgggtgctagagctactaggaaagctcttgggagtcttctttgagactttgcggtgtggcttctgatgaactgttaatttggagacttgcataaatgtaaataaagtggcattaggacagtcctcaaaagccaaaagatggaagagtgcaaccaaacctggctcatttgcaattgcagtgatgccttgtggaaataaaattaatatctggggtacagtggctttaaagcaagatcctagatcactctaaatagctgtgaatcaggaaaaaaaaaaagtttccggttgctggatattctagatcttcatttctagattccaattatttaagagaccacagagcctttgtcaccaggacagagtcatttgctctgataaaggggaacaagatcttacaaagaacgttgttgatgtgaacaactagtttactgaagacaagtccttcaacacaaaaagaaacaagaaaaagagaagggacaagcaaattgttatcgttcagtcactccttttcaatccacttgttactatcctgatccaggttctcattatttctcacctggctaattggaatagcttcttaagtatatcctctaccacttagttcatgcctctccaatctgttaccacctctggagttgtcctgctaaaacacatgtgtaactagattactaacctatttcaggaccttccacagctcttcattacccaaaagtaaaactcaaggtttatttggccatctacaccactactccccgtaactttttatcctcattcctatcattacctccatgatctctgaacttcagcccatcagatgacctcactctaacacctccttcttttatatgttatttcttcataaacttggcaaaactctacgcaatcataaaggcccagtaaacatgatacctttaaaaaaaagatttttccaagaggtgcctctacttcattatatccttcaggccaattcatgactatatttccttttcttatacccagtagttcttacttagaatagaaccccaggaggaagatatgactccagccacactgttctgaattccatcctttttataaggatgaaatccagaacagaaaaattctgtggcagaatttttcttctgactgaaactgcaaggagattcaagcactaaaaaagatcattccatattcccaatcagtataatgacaacgatagttaatcccagtgtcaaggaaattttcttctcatttccatcttgaagctaaatcgttattctacttttcagataaaagcatattatatctaaagggctcgggttatgggattcctcaaagaagcagtcaatagcttgtaatccttgagcagctcttttcttgttcccatgagccccacaggctgaccccctctattttaagcccctcaaggaatctggattcccacatacccacttacaggtaaaatttttaaaaagaaaatgcatatgcattgtattttcccatttaagatattaacaaatagtcatatggccaatctgactatctttactaatgactgtatgcaatggctgaaacaatcctctcggtacacaagattttgtgatatttgaatacatactatactcacaccacaacatctatatccttaaatcactataccaatgcacaaacagtttacatatcaattcatgattatgtgttcacatctttctgtctagtaactgctggggttacaagagtgaaaaaaaaagcacaaccttttccacaaggaacttgtagatgagcccaacaagtgcaattaccagatagtgtgatgagggctttgataagcatgaaccagggatctaataacagagtaatgcagtagaatatcaaaaaagtattctaaattaaataatctacaacagaattgttcatctttaatttagtaaaaataggtttatgacactcatgctctatggccctgtaaatgtagcatcatttcacaccacatatgccccctactacagttacagttactcagatactacatggctcagcacgcttgttgaggatatcagaaatgataagatggtactttcattattttctattattcttttattctggcttttaaatgatcaatgtttaaaaggatatattttccattttttttaataaggtcacaatactctttctgtaaccggaccccagtccagctgctctccacttgaaagccaaacagagagccgagggtagatgggaaaagcaggtttaatatgagagccagcaaactgagaagatggcaaactagcattctaaagtaccattttacatttttaaattcaccatgagattttaaaaatgaaacataggatgggagacatgcaggaattctgcagggtgcagggtttgtgtgtcttgttctcgaggctgtattgggtaattgcgcctctgggggtctggaagttgttatcttgacttcggcctggtggtggtggacaaattgttcacaagtccccctaagcttgatgatgcctcaatggggactgcgtggtttgtttctaggtttgactctgggatttcttaagcaagagaataattagacaagcatgcattactggcaaggagtgtccagaggggaagaaatgaagggatgagaggggagggaagggaaggaagaaaaagaaagtgggtgaggtccccagttacatttctactttaatcttgatatttatgcctaccaaatgcaattgggagaaacagagcattattggaaataaatcacttttctatctctccacaggagggtagtatttcaaaaggcaacatacattttgggttggaggaaggggcgggtggagagtgaatgattccattggctgccacactgaggctcctggctttctatggaactcaaagtgggtggcagcaagcactcttctagcccagagaagtctgttccaggacgggctctttcaggagcagctaaagtcaggggccatgtccaccatgtgatagaaagacaagatggtcctgaaattctccgtgtccattctttggattcagttggcatgtgagttgaaaaggttcccaattaaattaacagaaaatccctgatggcaagttgttttatggcaaagtatgaaaggaggaattataaaagaaggaagaaagggggaaagcaagggagggaggagaaaggagtaaggagggaggaaaaatcatttcaggttgggaaacaatccctaattcccttccctggttccttctgctctgtttctaaacaggggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagactggtgatacaggcctctacctctgtgcaggagcacagtgctcttgaggcacctgctgcctgcacccaaaccctgctgccagccccagtcacgaggctgccacatgcctccagctccgcctcgcacagcttatggcatgaatagagagaacaacctcagcccctcatggaaccatttctgctgcctttccagaaaacattttccacacacactggaggacaagacccctctgctataacacaaatatctggaaatgcagcctgctattaggatcattaacgatatgggcctgcaactccccggggtaggcagtagcaaagagagtcgatatagagggacaaatggaagctatcagacagactgtttctgagtgttccacccctgtgtagaaacaaagcagaaggcaccagggaagggagctagggattctttcccaacctgaaatgagtttttctccctccttccacctttctcaccccctcattctctctttcttccttctttcattaattcttcctttcatagttggcatcagggattttccatctctttaggattttctgttaatttaaatgggaacgccttcagctctcatgctaattgaatccaaaggatcaacatggagaatttcagaatacttcatggttcagattggtcattccgttttccagaagaccacacccaggaatgttcagtacaatggggcagaaatggatggtttcccagctttcttgtagtactccagagatgatgaagctgctatctttccagactcttacactgcagtaaaatgcagaagtattgtaaaaattagaagaaagttactacctttttggaagaaagataccgatagtacacctcagtagcatccaactgtggtttcaaagcaacatcctagttggtggttctgaaagtgaccaaacattaactacaatggcctgtatgttcacaggactggcttggggaagagtctttgaatggcaaatgtcaataacttcaagttttcaagcctgaagaagaaagaagttggcagtttcctccacatagcaagccctccactggcccattttcatacttgaagcagttgtatttgttctgtaaggcaagatgatatagcaaaatgcacatgagtttctgagttttgaaatcaaaataacttaaattaaaatctcgtttttgcaattttctagctctgtgtccctgggcaattatttatcctcacctacatttccttataaattaatgttagtaagaacacctatcttgctgagttgctatgaattaaatgagataaaatacataaaattgtctcaagttccaggcataacatgtatactcaacaaatgtccttaaaataatattgttattgatggccgtatgtaaatgtcacccctactgtggaattttcactgactacttaagggggaatgagttattctctgcctaatactctgagtcctcaccagaggagtcaggaaggcagacactgcaagctgccaacctaatcacaattcttttctgcctccttattaacaataccctcaattttgatttgggcaacaatatgtccagctttaaaaaagctcaacactacattttaccctctcttgcagcaagagattgccatatacatatagaacagttctgaccagtgagataggaccagaagttggatagggccttcccataatgtttttttctctcctgatacaagtacacatctctctatccctccttttctctttttaaaacatggaagagataactttaccgtaaaggaaaacacataactaatcccctttccttatcccatgcctggtagtcttttagatgccaagtcaaatccagcccccagatttaattttgcatgaaaatttttaataaaccattatttggttgagttttctgttgctgcagctaaacataattctaactatagtaagattgacataaaatggctttatgatttcttgtttccatgtgtaaaggcaggaaaagatatataaacaaattactttgtttatacaaacatggggactccatttatgttgatcatatctgtttcataaagtattaatattcctatattttttataaaggaaaaaaacttcacctttcatttagagaggactcgttattaaatttccatagcaatttcttatactcatggaagattatggaatccagatttcatcctaaagtcttttaaccacagacaatttccatgcaaataataactatagtcttacatttgtcttaactttatattccaaaggttatttttcttattttcttaaccttactctacccagtaatccattttaaaagcctcctctaaaaactttatcacattaaactccttcattctgaaaattttaaaggcaaatacaaataaaaataagaaaacaattttaattatctctgatgcaaaaagagaaagacactctcccctccctttcgttagagcacctactttagaaaacttgtaattgtgagttttctatccctttgaaatgtaggtaaatctttttaaaagctaaataaatcccttgccagttttacaatccaggactgtctttctcaagaacctgagagcatttttttcaaaatgtaatcacgaagggaggtagtgccctaatctagttttagtggagaataggtgcctaacttcagctggtactttgctcccagttgcaaaccaacctcctgtcataaagatatgagaaatgtttcctttgcatgaaggcaattacgaaacaggtggctacctcaattaccaggtaaattgaggatgaactatgtttgaaaaatgatgctgtcaagtcctctttcttgcggactagttattgtttatcttgagaaactgtaaacaatcagttgcatctgctcggctatataaaaggataagatttctttatttccttgtagtatctttagtggattgcctgtgagatgcatcacattctggtttaatgcttattcaataaaactgtttttttttttttttttttgagacagagtctcactctgtcacccagactggaatgcagtggcataatcagggctcattacaacctgtgcctcccaggctcaagcaatcctcctgtttcagcttcccaagtagctgggaccacaggtgcatgccatcatgctcagctaatttttttgtatttttatatagatggggcttcaccatgttgcccaggctggtctctaactcctgagctcaacctatctgtctgccttggccccccaaagtcctgggattacagacgtgagccactacacctggccaaaactgttttctttctcttctacctttgtgggaaggtgttatgggttgataggagattctgttttacttcctcaacaaaatggcccagggtctttccctaatcactgggcttacatgtctcttcctgaaaagcaccatgacactatgaaaagagcaagggtttctaaaggctctgtcccttattggctgtgtaaatttgggaatattatattaacttcatgagcatcaatttcctgataagtactgcagaagtaagaataaatacttaatttacagtattattgtgaagattagcaatgttttggtaactgcctagcataatggacttacaaattaaaaaattgaaagtgggaaccacggcttccacaaggtacactcaaaacctcatttgtgtcctgatatatgttttgagccaggaatatgtgtaagagttaaagaaagaggaaagaaacacaaaacacagcttggcagttaaagacaggtttactttagataaaacatgagaggggcttctggctgatttatttatttatttatttatttattttatttttatttttattttttggtcaggagcactttctcttgcagactaagagtatatattggttttagggtgagggggtttatcacaatcttggaatgtttatgtgtggaggagaagtttatggcggggtttggaatctctctgggaggaggggaggttatcttgaggctgatgtctttttggcaggagggggattatcttggggctggcaccttcccagtcagagcagggttatctcagagctagcatgcctctggttggggaggagtttggaatgtttctggttggagatgttatttgtggtttatggtcatgctgaccatagccattaggctgatggcctttggacttaggaagtttttgattaaggtgaatgttaaaatgagggcttgtccaagacagcgatgctcctgctttgtcaatatggaaaggacacagtccctgcttccaaggaactcactctcatggtgatagacagtcatagacttgctcccatagccatcattctccaggggctataagttgaagaatcctctgacctacaacctccattcagagcagtaatttctgagagaaattgcacactctccacactcctgaatcactgtatgccttcctaaaaacacactgctgatgtttaagaccagactcaggcaccacccctgggtggggcatctgcattgctgcagaggaagtggtgttagctctagggggtactctaacctgagaaaagtctccttaggctgtcaggaggattgatggatgaatggagaataaaaatctctgaaacaggaagaaggctaataatttaggctgagggtgggggatcagtagcaaaagagtatatggaccataaaattcttaataacatacataatcctgctttcttatcaccaattctcctttatctccaagagccaagatgaagcttaagatttaaagaagacaatttgtttaacatttatttatagttcatgaattaatattttttagtatcaggggccaatatgagactagatctgtttgtccagaaattatttctaatctctgatcactgttcttatctaaaccatgcctatggacatagagggtagaaggatgattaccataaactgggaagggtagtgggaggctggggaacaggtgggactgtttaacaggtacaaaaaataggacgaataagacctactatttgatagcacaacagggtgactatagtcaataataatcgtacattttaaaataaagaatataagtggattgtttgtaactcaaaggataaatgcttgaggggatgaacaccccattctccatatgtgcttatttcacatagctttcctgtaacaaaacatctcatgtactccataaatatatgcacatacttaagtactcacaaaaattaaaaattgaagaaactcaaagccaagaaaaatttttaaaaagaagcaaattgagaaaatgtaaggtgtagctgggaagaaaaggatagagaaaggttaagaagaaaattatggaggactgtctgaattgaaaagcattgtctctgtgagtttgtcaacagcaacattactagcattttgggccgggtaattcttttgggggaaggggcttttctgggcactgtagggtgtttaacagcatccctcatctctgcctactagatgccagtaagattctcacctgtggcaaacacaaatgtctccagacactgtcaaatgtccctggaggcaaatagcccctggttgaaaaccaatggtctatatgtctacatattgaatgttgaattgatagagcaggaaaaacttttagaaggtatatatatgtgtatatatatatttagtatatatatgtatatatatttattatatatgtatatatttattatatatgtgtatatatatttattatatatgtgtatatatatttattatatatgtgtatatatatttattatatatgtgtatatatatttttattacttatatattcatatacacaaaatgaggatgttaacatttttctactattataacacatttttattcctatggtggtcatacgtcctaagttgctattatttcatttggctttaataaattaaataagataatttcaatgtaaaaacgggaattgtaatatatatatataaacatatgtattttatatataaatatatataactttttatacaattcattcacaatgcaaaaaatttttcagtctgatcacgttccagatttcaccttggtcaatatcttttatctctgactcctcaaagacatatagactgtttctctattctttctctaagctactgtgttcctgttcttccccaaaatgattcttaaaccctaaaaagatgacccctccattaccccccacccacacacaaacacacacaaggactcacgcatacgcaccacagtgtgcagaaggtgaactaaaccacaggtaggtggagttttccactaggaagctgaggggcaactcccgggagctgctgccgctgaatctgtctcatgaaatttctcagccatgggaacaaaattagttccaaattcaagatatgatacttaccaatatttaaagagaatagatatcaaggtgtgcccctgtagcaaaaaaagtaaagaatcatgaaggcattaataggaatcttgctgggcttcctgtggatacagatttgctgtgagttaaggacagcccagaggaaacctggaggagtatcacaactgaatttggaaaggagcaatggaggaacgggagagatggagaaagagaaagaacgcaactctcaattaagctgtgtcctctatcataaggaagaaaactacagagaaattttctacacttggaaacagctacagtgattttgtgatgactctcatctgcatctacttttctctttctgaacgggggtaaaagcgcaaatgaaagtggagcagagtcctcacgtcctgatcctccaagagggaagaaattcattcctggtgtgcagttgttctatttacatgatccgtgtgcagtggtttcatcaaaagcctggaggacccctcatgtccttatttaacattaattcaggaatacagcaaaaaagaagactaaaatccgcagtcaaagctgaggaactttatggccacctatacatcagattcccagcctgaggactcagctatttacttctgtgctgtggggacactgtgctcttcagacacctgcagcctatacatgaaaccatagctgaaggcctaacccatccccgagagtggcagtaggtcccgatgtgattagcattgcattcccactgcctacatctccttgcatgtcctgattcatgtggaaagtatttctaaatgagttgtaacttgacactatggtgcaggtgcataaatggttcccctgcagatatctgtgggaatggtattactaggcaaaatctattgattgatcaactctttcatatattatcatatctctctggataagaatgagcagagtcctcaatcctccatatccaagagcaagaaagcaccagtctcacctgtacttccttttccacatcttttttatggcttactttagtacagacagaatcctaggaaattttccatgatattttttctaacagacttaagtgaagatgaaaaggaagagggaaaatagatggcctctactaccatgaaggatggtcagagctttctgcatacttgaccagagactcagccacttacctctatgctgtggagacacagtgcttcccaggcacctgaagcctgaaatcagacaagtacctgcaattctaagactcaacaataagttagagatgtccatgtgttttgctgtaacatggttttgagaagcatacacttgataaatcaaagtgatttcatttccaaaaaagattctgatgaatacttactctagtaactatctctgtgctaaacagaacaattcctaacatcctaatccctaaatcagggaatcaatgagtcagaaattctagataaaggatccctcaaactcaatgataaggctttctgtcaaaaagggtatttgcaccccgaatgctacttattcttatcttacattatctatgtataaaggaaaatcttgagaaagtcaaaccaaaatgtgtcaaaaaagacatgctaagctctctaatccttcattatttttttttccaacttcttttttttttttgagtcggagtttcactcttgtcacccaggctggagtgcaatggctcaatctcggctcaccacaacctccacctcccaggttcaagcgattgtcctgcctcagtctcccgagtagctgagattacaggtatgcgccatcatgcccagctaatttcttgtatttttagtagagacagggtttctccatgttggtcaggcttgtctcgaactcccaacctcaggtgatctgcccacctcggcctcccaaagtgctggcattacaggcgtgagccaccacacccggtctccaacttcttaaagtatttttaattgttcattttgctcatattcaatagtatctatatcattttcctctttgttatgttttgtgaaggttattagaaaaaagcttatttccagtcatgagtatgctatgtcatcttcagcaagtgagtcattttatttgtccctcatctcagaatcctcatttataatgtgaagatgatatttcccacccaccactactcacaagtttgatacattaattattcaacaaataattatcaaatacctattaggttctgtagggaactttgaataaataaagagttctttccttgttgaatatatttctagtggggaacacatttttattatcagttcctataaaatagagaaggacttaactggcacagtaaagggtattataaaaacaaacagatgtctgttaaaggaagctttctggagtatgtggtgcctcagttcaaaatctggcaatttaataggagttaatcagactgaagaacaaaagcaagtgggggaaggttctccaatttgaggaacagcatacatatataggcaggaagcaaggcagattatagcaattttaagacataatgtataatttgcaagttattaaataatgttcataagtaactcttattttatgggagactaaataagaaccttgaaatgaatcgtctgtaaatcataatatggtaaggtgaaggatatggggaacaaaattactaagcatatctacatcctaacagagcagataaagataactgcactaagaacaaataaaaataatcatgcaactgattgatgataagaaaatgttagttcttcagagaccctaatcccttttaagtgtggaaagtatttctaaataagttgtataagatatgataaatatgatacataaatgtgatccattttgactattaaataaagctgaaatttccaatttgataaaagtctccactgattcaaggtactcagcaaactctaaacagggtaaatgtaaagcacatgcacacacacacacataaacacacacagaacaagagaaatgcatacttctacacatcagagtaaaactgctgaaaatcaaggaaaaagagaaaaatccttaaaatcagctttgcttttgtttttcaaagggtcaatttcatttccctcaagtttttctgaaatcatggatgagtgagtctagcaaatgcccagccctcttcaggagccgggaaacatatgtggcccagttgcaaatttggggacagcttatggaggcctgaagatcactgcatttgatccacataggtagacacctgagcagctgggctggccaaaactaatttgacattatagtataggcaagagaatggcatggactcctcattccagtcaaccaaaagcaaagaagaggtgttattctactggctgagatgattgatgctgcctttcatggagaaatggtttgctacaatacagtgggggtaaagaagagtatgtctgtggaaactcttaatcccaccatgaatgatgataaaatttaatggaaaactacagcaactcaatataggcaggactgctaagacatagatcttgaggttatcatcccaccagacaaagaaatatgattgctgagggcaaaaaacaataatgaatgatggcagaagaatgaaattgtgcatactagctacaacctcttgaccagtgacagaaacaagatctgaagtagttatgggtacatcttccttactttgatgtgtgtgtgtggggcggggagggttaacaacccattctttttatttcttttattcttctactgtctgcaatagtatgtgtttttatttgttagctttatggctcactataaaattcacaggttatcaaaggagaagtatgactcaactagaaaaagaataaacttcatttaaagatgtataaagtgacacaagggaccttgcattttcttttggggaaaaggttagcatccttacaattttatggaagaaattgcatcctattaggtagaataattattttactattgtcttatatggaaattaaataccatcaaatgaggtatgacctaacgcaaagtttataaggaggtacaaaatggtggtttgtactggattaagcagggaaccaagtttcccagagtttccttttttgtatagtagcaggataaaattggccaaagagtaatgtgtgtgagctatggaaggcaaaagtgaaacagtagccactgctctctgaagcagtcatttgtcatatctgacaaatagacacggatatgcccagcaggtgccagcatgttctaactctgttccactccatgcctagcatgccttcctgctgaccagtcaccttcagatgcctggcgatagatgaatggagatggtaaccacacaaaggcaagagcttccttagacttctccttgaacttccccttcaaatcacacttcagcagctgcaaatgcttggtttctcagattaactggttagagtttccttctctggccctcccacagcccttagaccttcactttcctgtctcctttcacaatcacgtaaagccaaattcccataattaagcccctatcccatacaactcatggtgactttcctgcacttgacgataccctgattgatgcactagacaaatataaattagttcaatggaaagttgtccgtcttttaaaaatgtgtatccagatacctattgggagaaagaacaatcagaaatctagtcttaccagaaaaagagtagaccttaaaagaacacatgtagcaaggtgagttgcaagggaaagaagagagggaagaaagggatacagcctgtgggctcctgcatttccatgaaacactgggtgtaaagaatcaaatttactgaacttaaagtataataataaaaaaaatctatctatatatatatacaaagaatcagatttatcactatgtgaagatgtaggaattatttttaattaaaaaattctcatcagaaagaaattacttataactttatgaataatttaacatatgtcaatctaattctgtgttgttaaagtaaagatatcaaaggaatagctctactcccatgtttcagaaattcctggtagtataactgagtagtctttattagggaagacagacttctctaaacatatctggtgactcagtttggtgtatgcaaatatgaatatggatatgctatgacaagtgtccccaccccctcccccaactaatttcctgtgcagagacagctgtgtcacccatctccactgattctgcaagggacttgtcataaaaactgaataaggccaaggttcaggctctttagagtggttacttccctaggaatagaagtgtcaacgtgacttttataacatgctttgagcacgttataaaatttgtaaattgataggctcatcttctgctctcccacaagctcaaaacactgtgaattttttacatctccagaatagaacctcttgctcttgtgtggcggagccatcatcagttcttttaatgttcaccactctcggtagataaaagttctatttcattctaattgttctatgatatgatttagaatcactttaatgacacagtcttcagtgtgagaacttctcttggttccagcatgcataccccaggaggagcagaatctcctcaggtctaggggacctagtgggctgtaatactctctctttctctctctttctctctctctcactctctctctctctctctctcacacacacacacacacacacacaagcaacaaggtgaattcaccacaaatataaaattgtgagccaccaataacccacaatcagcctcaaagcttgctgaaaaatctcgcactaacacccctcccaaataaaacagttttctgtagcaaggcatagagtcactcatatccaatgattcaacatggggcttgtgatgcatctgtgcattgtgtattttgtacttttgttgtctaaatggtgagtctgtgtgcatgtgtatgagagcacgagcgagagagagactattacagaccactaggccccatggacttgcaaaatcagccttcttatacatgattcatgcatggatcctcatgttttgcgtgtgaccacccttcctaacatcaagtcataaatttcctacagacagatactgaaattcaactataatgaacggagttcatttgctgagcactcttggctataatttgtctgtgtacttttaaaattgcagatacctttgtccggaatgcccttttcctacaaagccaacttgttaatcttcctttatctcttaaggccccagctgaagggctctacctttgtagggtcttccctgactccacactgctaacctcctcagcagaactaatggatcaccgttatgctttcctcataaaaacactcatgtctcgtgctatgttgtaagtatatagttacacatttttctttctcttcaaattaccaggtatttatgaatgaagattgtcccataaccatatttgagactctaagccaggcacattgctaaatattgcataaaaactaaattaatattgattgatatataaatacacaaataaatcaatgaaaatttcttcactagaaagtctgaattatataggtttaaagtatataatatgcaacacagacaatttatcagtttctcctgaatcaattatttttaatagactatatatatacatacatatgtatatatatactatatgtgtatagtacatactatacatatgtatatatatactatatgtatatactatatattatatatgctatatgtatatactatatatattatatatatactatatgtatatactatatatattatatatatactatatgtatatactatatatattatatatatactatatgtatatactatatatattatatatatatactatatgtatatactatatatattatatatatatatactatatgtatatatattacatagacatatatattttttttgagatggagtttcgctcttgttgcccaggctggagtccaatggcgtgatctcggcttactgcaacctccatctcctgggttcaagcgattctcctgcctcagcttcccaagcagctgggattacaggcaggtgccatcacgcccggctaatttcatatttttagtagagacagcgtttcgccacgttggccaggctggtctcaaactcctgacctaaggtgatccagccgccttggcctcccaaactgctgggattacaggtgtgagccatgatgcccagccagacttaatgtattaatggacttaaaacacttttaatagaggcattttaacttttctgagtatttgtttcattattcttcaagtgaaaattcaaaatgtttattaccataataaaatatgcatcaaatattattttattatgtgttatcagtccttgctaaaaataatttcaaaaaacattttggaatttaatctcagctgaaatcactagttgccctactaattcagcattaaaagtacaattgattcttcttccttcctccatcatagtaaaccatggggaaatacattacctgtggaccaagagtgaagataagcagctatgttgcctttttggcatcttctggtaaatttcatgaatatattgtctatagactttacaggattatgtcaccgtttttctcttttgaaaatacagaacacactaaatgatctcattcaagttccaatagagataatttcagttcagaaggtgatctaatacagaagataaattttgttgtgctgatttgtgtttttgagagaggtacccagaatttaaatttaatttaattatgttgtgctatttatcatatagaaaatatgggcatatttgaagaccatattagaattcaattgcactaaagagtaagctacgaaacttctttgtgttctaaattcatatcattgtattaaataaaacatcatacccatatgcgtccccaataagtatcaatccttattaatgtttttaaacaagatgtctgccttagtatgccagttgacaaggtgtcagtcatttgaccttatgtaattctctaattttcagctatcattttctactattgctgtgtgtgtgtgtgttctctaaaaacttttccttctctttcaatctcttgttttttaactttttatggagaaggcattataaaatcatctttaggaaatacagaaacacatttacagaaactttctacatttgaactaaagggggcagtgcttcctttcataaagataaataagcttagagctccacacaggttgttcatatgtaaaatgaagggtctgtggaaggacatgaataaagcacaggaggttgaagtcagatttgcagctttctaggcaggagataagacaatctgcatcttcacaggagggatggccatgctcctgggggcatcagtgctgattctgtggcttcagccagactgtgagttgtgcatgggaggtttgaatatagtaagaaaagctacaaggaacactacaaggctgggagataattggagaagttttgttttgttttccggatcttgatggtttcctgtggggacattaaaaataaaactgaaaatctgttattctctttccaaacaggggtaaacagtcaacagaagaatgatgaccagcaagttaagcaaaattcaccatccctgagcgtccaggaaggaagaatttctattctgaactgtgactatactaacagcatgtttgattatttcctatggtacaaaaaataccctgctgaaggtcctacattcctgatatctataagttccattaaggataaaaatgaagatggaagattcactgttttcttaaacaaaagtgccaagcacctctctctgcacattgtgccctcccagcctggagactctgcagtgtacttctgtgcagcaagcgcacagtgctctccaggcacctgcagcccgtactcaaacctgctttggggactcagactgggagacacatagactcgcttccatttacacatgccaatatgagagattatgctttgaagtaggtgaggcaagttgagcctaaagaaagactgatacatgacaaaaccttacaaataagttaagaaagttccctgagttttagagtgtttaagagtctaaccactctccttttctactttcagaaagaggttgctgatttagctaaagcataaatctctagtgatgctttgtttctgctagcttctggaatgcgggtgccctgtctcccttgtatactagggggcaaggatgtgtgtttggaatgggaaaaccaaggtcctactgcaggttcttccagtgatgaacatttcctgagatgtcttttcttttagtttttctcagtgtacaggcatttctgagcaaagaattgcatgtgtgaatactaacttatgtatatctgcatatctataaatatttctatatgtagcataaccatctgtatctatattaagttaaacattcgttcttagcaatgtctccaatgctaaatcattaccacgtggatcacactagcctcctccccttacttatccataaattcccactacaggggtgcacagcctggctctcactgttaacaaaaagttattcagtaatacttgttaaaacacggtgaggcagaatttatttaggaccatcatgataggtacagagaccactgcaacaggattttgcagtgagggagaagaattggattcaactccgaatacagcatagacaagtggagatttctagccaaggggcagattaggggtcagtggataggaaattactaagaggaaacattagaaccaagggatagtctggctagaccagccaaacaggatccttgcagaagacaggtcagggtgatcagacatcaatcccctgggggatgatagaggatgaggagcccagttggatatggagtgtaatcagatatcaagcggaggatgacgagggcagcaggggagggtgtggttcttgctaaactgacttagaaggattcttgttaaaactacattttacaagaaaatgtacagatgagcttaggagaaacttcaaaagcctgactaaagtttggtcaagcaaagaatttttgtcattaccacccactattcatttacatcatagtccaattccattaaacatgtatagtggtatcagaattgttacttgtagctccatgagaaagaattttatcacttagagcacactgttgtgtaatggtaataatgtctagattatgttgaacttctattattccacctgttttgcatgtattacattaattcttctaataattatttaagacaactattagaataatccatattttagtagagaaaacaggctgtgggagttcagggatttgttcagtatcactaactttgtgagaaaagagagttcatggtcactcatgccccaaaccaccaagtatgggcccttcctacagaagctattaacaagtcatgcttttgaacagctagcaatctttaaaattcttatcatacatgtcttcatcattgacctatagaagagtgagattatcactcatagagaattaaaagctgaaattatggttttatatgtatattgtatttgtagataaatgattagagcttgttcctcacaggctgattttctgaagctgaagatctttacagagagaagatacagaaattcaggatacttcccaagaagcatgcggaagcctctgtaaatcccattacttatggcataatctgaacagtgacttcaggaacagtgatttcaggaatgctgaagacattttttatcagaataggggtgatatataggttggcttagctttgttcatctagggatccttgtggggttggtttaactataaggtaaaatctgtaggttgatcaattctctcatatttaattctatattcctgaacatggatgtaaagctaactcagtgtgaattagatttattatccctccatatccaggagcaccaatatcacatgcagtattttttctgttctttttatggcttacattggtataggcaggaaaaattccaagatccttttcgtaatgcacgtaaatgagaatgaaaagcaggaaggaatattaagcatcactcttcatacttagggtattccatgcacatctcgggctcctactctagagcctcagctactctgagcagagagtctgctgtgcatactctttgctcacaggcatccagagcctgttcccaaattcaaagctgtagccacagatcccagcaaaagggcagacacgcgagagttgttgctgtcttctagcagggtgtagagaaatgtagctacgatgaatcatttcatttcagtttcaaaaaatgtggaaattcagctgaataatcagtccagttactatatatccctgctcttaacaaaactatttcaaataccttaagacaataaatcagcttttcttcttttcagatatatttaacatgatttataaattactgaaacccattataaagttctgttacaatggacatttttcactctaactgctgttacatttaccccatttcatgtcttgcataatggggagggaatatattaatgctgtctttatccttctaaagcaacgtagaatcataccagaaaaaggaatactacattcaatctcatccctgtctttttgttcaagctcttcagactgcttcaactttcacatttcattcattcccacagttatctatttacgttcttttcttatctaatatatttgggaaacagcattgggaaaacatactttctagcattgttctagccataagtgtgttgtgtcttcttgagcaagtgaatcaacttcttaacattttatatcaggaccttcatctgtaatgcaagggcaatgatttccagctaacatcggtctcaagttttattcattttatcaattagcaattgttaactggttgcctgctgagttctgcataaatgttacatgctgggaaaaaaagagctatggaaaaatacatatcttctttgactaaattgtagtctagttagttatgtaggcagctaatcagacagagtaaagtgaaatgaggccaaccttgggaaagcaaagggaggtatgaaggcatatggaaagtcccacccccatcttagccttagaggtgagtcaggggcagcctgtagtatgtcttgcctatgctgagacctaaagatttagtaggagtcaatcaagttgaaagacagagaaggtagtaaaagtgatcttaaagatagaaacagcatgtacaaggtgacacagaacacaatgaacctgaggactaaaagccagaattatgctataattaaaattatgtatgtcataaaatgttcaaaccaccactgcaaagcagttgtaccttaattctcagttttataaatgagtaaccataatatttgtgaggttaccaaatatgttttctatttacttgagatttcacttaataaggttattcatttgatacctaatatgtgtcttagacttgaaaacaatagatgcaaatgagaagaataaggcattgtttctgccttcagggagcatgtaatattgcagagtgtattacaatatagtataataaaagctatcataggagaagcgtagaatataaccacctaacagtggcatttaatttggaaacttaaatgtaagggaaagctgcctacgggaagtagtatctaggttaagatctgtaaaacagttagccaaaaatggagtcagagacagggtattacagaaaaagataaatagaatgtacaaagacatgaagtcaatatttaggttaagagaatgacattaaactaattcaggatggccagagcatacaactcaaaatgtatgtcagtaaatataaaactaaagcaataagcagaaaccactttgtgaaaataattaaaagccattataagatgtttgtacattacattatcttgaagacaatgatgagcagtgaaagaaatctgcacaagtaaataatataatgaaatgtcactgtttgaaagattactatgagttcacatacttatatattatatccatgtgtgggcatgtatataaaatatatatatgtagtaaaatacatataatacattttcccttgatacttcttttttctcttaattctggagtaattctttctgtaacacagtatattgataggcccttcttatagcaagaaaaaaacctatcctgtatgaaaacttactcaagaaaagccaaaatccacagtttaatcaacattcctcagtctggccacaggggagagctgtttaaaaagtattctaggtagatgcatttagttctctgcagttaaactgttgtgatgtgtctctgattggttgcccccaaagttgcaatatcctggaagcaattgcaacaggcctcattctgagttcaaagcaactcctgttaaggaagcccattcagaagctgactggatattctggcaggccaaggatggagactctcctgaaagtgctttcaggcaccttgttgtggcagttgacctgtgagtacacgattcagtctgggagaggttgtgatatgacagcatcttaatgacaatagctttctgtcttgggaagggcccttttaagaaccagacctaagaagtgaggaaaatgtaccgtaattatgtggtgatgcttaatgttttaaataaggaaggaagagagaaaatcacccttcccttcacgagattgagcatctcattcgattgtctttctgatcaggggtgagaagccaacaaccagtgcagagtcctcaagccgtgatcctccgagaaggggaagatgctgtcatcaactgcagttcctccaaggctttatattctgtacactggtacaggcagaagcatggtgaagcacccgtcttcctgatgatattactgaagggtggagaacagaagggtcatgacaaaatatctgcttcatttaatgaaaaaaagcagcaaagctccctgtaccttacggcctcccagctcagttactcaggaacctacttctgcggcacagagacacagtgatacccaggcctccaagacctgtactcaaacctaaagctgagccgcagatgctcccctagcatagatgcccaccacaggagtatggggaacttaccagaaggttcatccatgataaaagagaaacctgaaggaaattcatttgcttcaacatataacacaaaaagcaagccatggccttaagaccatatctaatttggcattgttttcttgataattatttaattgctttgttggtattatatgatagataacttagattcagagaaaattacatagatttcagtttcaaaaactggagtgaattcctatttgactgaagctatacatataaactccttttggatctctgcattcctatctgaaagtgaaaagtaacctctctttcttctcctaggtacccacagcttgacaataggacagcaaaaaaaaaaaaaaaaaaaattgtctggttctttcttggacgtgaggattgtacacggtaggtatttagattgttaatcttgttacctatctggaaaggtcactagcattattttttccaaggttttaaatatctgttttggggaaatggcatttagaagtacttcaattttatatttgccttgccttctcttctcattgaggtttattctgattgatttccagctttgcccaagggaccctgagttatcttaccagtttgcccaatggtcaagatccttcctcaattgttcctttcacatcaacccagcacaacactgcatgtaggaaacactcaacaagttttaattgagtcatatgttgataagaattgagaatggccaggtgtggtggctcacgtctataatcccagcactttggaaggctgaggcgggtggatcacttgaggccaggagttcaagaccagcttggccaacatggcgaaagcctaactctactaaaaatataaaaattagccaggtgtggtgacacacacctgtaatcccagctacttgagagattgaggcatgagactcacttgaacctgggtggtggagtttgcagtgagccgagatcacgccactgcactccagcctgggtgacagagtgagaccctgtctcaaaaaaaaaaaaaaaagaaaaaaagaaaaagaaaaagaaagaaaaaacaaacaaaataatcacacacagaattccttccacaagatcagtcttccacaaacattctacaacttgcttaaatctttagtcttgtcctatcagtctaccctagaacaaaaatttaatttttcaactttctatattcattgagttttatccatcattttttttactcagaaaactttaaaattaactttttaaaaacttaattttaaaaaattaatttaaaaagatctccatgctgggaaaaattactttctctttaacagaaaccagattcccatgccttcttagaagctttttatcaaaaacacaaaacaactttatacactttgcatatataactgtttctcttatagctagtagtttgttgttttgttttgtcttgttttgtttttgagatggagtttcgttcttgtcgcccaggctggaatgcagtgatgcaatctcagctcactgcaacccccgcctcctgggttcaagcaattctcgtgcctcagcctcccaagcagctgggattacaggcacacactaccaaacttggctaattttttgtatttttagtagagatggggtttcaccatgttggccaggctggtcttgaactcctgacctaaggtgatcgggccgcctcagcctcccaaagtaatgggattacaggtgtgagccactgcgcccggccatagctagtataattatatacataaactgtaatgttacttcttagtaactcttattcttagtgaaaaactgaggaagtaagtaattctaattaagcaccagatacagagtccaagacaaaggacaatccctggagctaggcttcacaatctcctaaaggcccaaatccaaaaacatagtttatagacaagttaagtgtcaaaaattgtcataaaaacacattttatgatcttaaaacatctagcagagataatatctgaacaacaggccaatagacagacaaaatgtctaaattaaatttggaagaggtttctattttattttatttcaccaataatttttaaattgtctttatttgttaaagattactaaagtcacatgaacttaaaggtgtttgagttaaggtttctatttttctcataaaatatttaagtgtttactttttaagtcaattaattagaactctttcacatattttggttgtgaaacatcacatacacataacacatataaatatatagacactagacacacagacacacagacagaagcagatcttgtagaactatatgattttttatttaccaaatttaagtagttgtttttattcacagtttcaattacctattttattgctctaggcaactgttaggcgaccctaaatttgcatttctgaagtgataactctcaggtgaaacaagataaaggatttgcatctcaaaatacagacagagacagggaatttaagctctttaaatttggttgtgttagaggaagattgaaaacatggatgccaagtaacacaaaattatataaatttatcacgggcttttataaggtgaccaatttcatttagataggtgcttttaatttagtctcttttttatctggaccattgaattcaaagcataactcacactaaatcttgggtcccccaaaagaggtaaacaccatggggattaggacacgccatgttttcactgtacatttcactgcaaatacatttcccctgaggctggtgggcaacccattgccaatcagcccactctgcgatcagcccattccttagccattgtacacaccaaaggcaagcttttcacaataaaaagaaatttctagtaactccagaagcaaaaatttctggtagtgcaatgcaaaggagagaagagttttagatctgagaagacactgtccattttcaactcttgggattccctgaggaaaaaaatagcagtttctcccataaatgggtctgtggcacattttctgttttttcttaaggaatcccaggctgttagaatttgttgttgttgttgtttgtttgtttgtttttgtcttcttatgtggcactgagggtggcaagaggaaggaaagggcgatagaaagagagagacagagggagtgcacattcctagcagcggtttaagaagaaattcagttgcctgagaaatgtttacagagagagagagaacagaggccttaaagcagtaagtaaatacatacatagcctaaatatcagttttaattaagtcaacttttgactatggagccctttaaataaatcctgtcaaatctcttattatcagattttagctgagacaaacagttgatatttctgacttttgaacttctttaccaaaagatatacccccaggtgccttaatcaaggttattatataaccgtgggtacacaagctgtctccaaagagttggcaagcattttttaacaagatccagaatcaccccaaagatcgctcagcgaaggaaagtttcattaccaataaatggggtataacccatatttctgtcaggccatgtgtttagagtcttaccttctcagctgaccatatgcacacaaaggccccaaagcctcatgtgcccccaacagatgaaaaaagacaggaaacaaaaagctatggaagtgggaaagatcaatcataaagatcaataataaattgatacccaacaaaaaagtcacacaaatattaaaccgagaggggctggatccctgaccagtaatcagactcaccctgtggatgtgaaagtgcagaattttaactattgggccacaggtggagtggcctttgtttttccttgaccagaaagcaaacccaagcctctgcaggaattttacctaccagaactggtttaggtcagatttttcactcttaatttagtcaagagaatttttaaggctggccatgacactattatatgtcctttttaaatgtgatctctttgttaattgtttagaataagagatccctaaaatctttaaattaattgcaccgaaagaaaggatgggaaaagggtcttgttgtgtaaatgaaacttctcaggtagtcaaattgttgacctttcttacccagccagggtttttagaagtgaaaattgactttctccagctgcagagtttcattcaacattagagggggccaggagttggtaaagtctaacagaaggtggaccaaaactgaaaagaaaaaccagaaaaagtgatcacagaattcacatataattgcgatctctcagcataagggtaagttatagccaactgacaataaaccttgcccttcagctaccaaatcccaatatgaaaccagctccttacctggagatggacccaagctgaagactgctgtctgccatcatggaagcagaaactaccagaaaaggagttttacagcagaataaacctcagatcccaattgaaaatttgggggagatcagggatctctggagggagaagttcccagaacttacatagcaaatcatccaatctgtaagagtaataaagagctccagccggtaccagggccccaataggagacctgctggaggccaagagccagactccactcagagtcccttcgtggtcaccaacatgtaagccaaaaagtgactgaggcagatctctattgattagaggtttattttgccagtcgaggatatgcctgggaaatagaaacataagtcacagtaggatccttgacctgtgtttttccaaagagggttttggaaacttaactatttaaggtgtaagagcaagcaggagggaaaggggaaaaaaggagggacagtaggcaatgagacaagtggttacattcttataaggctttgattaacactcaatgaatccacattttgtgtgtgaaaaaaagagagtagaggaaaaaatcaattaagcattcatctcatcctcagtaaatctacattttacatacgatagagtaagcatgtgaaattagagttacctgtttgggaacagaaggaaggcagtgttttgtgtgactccgtttccaaccttaattttccccttggcataataactttgtggttttcagattttatttttctttccagattgagattcccatgaccccccatttgagttcaattaataattaatttgctagaacatctcatagaactcagagaaacacttacttacatttactagtttattataaaggcatacatatattacaaagcataaggatgaagagatgcaaagggcaaggtatgggggaaaggggtgcagagcgtcctcactgtcttggggcacaccgctctcaaggaacctccatgtgttcagctatctggaagctctctgaacctagtccttttaggtttttatggaagattcattaaacaggcataattgattaaatcattggccattggtagtcaaccttcagactctctccccttcccagatattggggatggagctgaaagtcccaactctctaatcatgcctttgtctctcccatcccccatcctgaagttacccaggggctgccagccatccgttcagtcaatcattaacaaagataagacatcgcttcagagtttctaagtattttaggagtcgtatgtcaggaaaaggggtcaaagattgaatatatacttcataatatcacaagtcataaaactgaatagtacttagcaaccaaaagaaataaagtactgattctttcaccaatatggataaattttaaagcattattctgaaagaaataagctagacacaaaagaatacctaccatataattgtatacatacgaaattttagaaaaaagcaaatctgatcgatggtgacaaaaatcagatcagtagtttccaggtattgggaatggaagaaggacattgacaacagtaagtcacataggaacttaaaaggtgataaaatattctatatgttgattaggatagtggttacacagatgtaaatgagggaagagagagaccctctcgtactgttttatattgttttatactcagtacctgttttaagaaaaaacaacaaggaagtaaaaccaaagacaggcagcctgacgccaggcccgaaaccaggtctgggcctgcctggcctaaacccagtagttaaaaatcaactcataacttagaaactgatgttattcatagattccagacattgtatagaagaacactgtgaaactccctgccctgttctgtttctctctgaccactggtgcatgcagcccctgtcacatacctcctgcttgctcaaatcaatcacaaccctttcatgtgaaatctttagtgttgtgagcccttaaaagggacagaaattgtgcacttggggagcttggattttaaggcagtagtgtgccgatgctcccagctgaataaagcccttccttctacaacttggtgtctgagaggttttgtctgtggctcatcctgctacatatacatttttcaaaaacagcttgactgttatgcttaaaatgtgatatattatttcatgtaatttatattcaataaaattaatctaaaaaagattaataaaaggatttagattctagatctcatgataatctgtaacacttcttttaactcaatagaagtaattcctctgttttaattttgggcaaaaaataaaagaaagagataagataacaagaagtaggaaaaggaaggtaacaagaggtagtatgcaggaattaaaattcattctcttaaattagaggacgattacatcccaggttcttcatttactgtatacgtgatcttgagcatgtgtctgagcctctgtctcctctctgtaataatttctcacaagattcaactgtctcacaaggggaggattaagtaataatatgtacataatgttcctagagcatgataaatgttcagtgaattttatctagtatttttattattaaccaaaggtggtcattttaagtgagcctaggttctctaaatcaaattatgggtggtaatcaacatggtatggcagctccagaatatttttttaatctgggcaacttgaggggctaggggtaaaagtagagaaaaaagataattgtattattatctcagaaactgtccagtagcctggaatcccaagtgctatagtttgaatgtttgtccccttcaaatctcatgttgaaatgtgatccccagtgtcagaattagggttgaatgggaggtgcttgggtcatggaggcagatccctctgaatagattaatgctctggagtggagagaatgaataagttctcactctgttagttcccaagagaactggttgttgaaaagagcctcgtatgtccccctctctattgcttcctctctcactttgtgatctctgcaaacaacagctcccctttgccttccaccatgagtggaaggagccggaggccctcaccagaagcagatgctggtgccattcttcttgtatactctacaaaatcatgagccaaataaatttattttctttataaattacccagtctcagtattcctttatagtaacataaaatggactacgatgatgggaaataatattttatcaatggaagtgatcttctattataactgagccaagagaaataaaattgaatagaatggaagttttcttttgtcttaacaaagttaccaaaatcacacattgggaggataagcagaagtctaagataatcagaaaacagagtagactgcaaaagaattgtttgaaatcatcaattaagatggaaaggaggcagggaaaacatcatagtttctagtatcaccctgaaattttgtgtgtaacaatatatgtatgtctatctacatccaaggatacaaaaccacatctgtattttaaagtaaaatatattttcttcactcaaaaaaatatataggtatctttttaatctcagtctaaatctgggaataaaattttgtggccccaaaatgtctggagaataactaagcaaactttgctagggaaagagctgtcttaaacacatctagtggctcaatttagtctgtgcaagtatgagcaggatatgatttaacaacttgtccctgcccctgccttccccactgtaccactttctttcctattctgagacagatgcattgctcacctccaataattctaggtggagctttatacaaaactgaataaagtaggtctcaggctctgagcaggcagttttttttcctagaaatagaggtgccaacatgactgttggcagcatattacgggcactcatggcctctgccttccttggtaaggacagtagctgataggctgaggacagtctaggactgggagaagacagtggggagggaagaggggatgaacaactggtcatatgtgacaaacactcaggtgtaataagaaggaagaggaaaggaaccagattctgactcctgcctttactgaaggtttaacccctgccccaaaagttcttggaagctctcttacaggtcagctcaggggaccaatcttgttatttcttctcatttacgggatccagcatgtcacagagggtcattcaatcccaaccagcaatatctacgcaggagggtgagaccgtgaaactggactgtgcatacaaaactaatattgtatattacatattgtattggtacaaaaggtctcccaatgggaagattattttcctcatttatcagcaaacagatgcagaaaccaatgcgacacagggtcaatattctgtgagcttccagaaagcaactaaaactattcagcttatcatatcatcatcacagccagaagacctgcaacatatttttgttgtctcaaagagcccactgtgaagaacatgttagaagagccttacaaaaagatcggaactcaacctgaggcaattgcctattcccacattctcaggaaaaactcacaaaccttacccaggcatttgttagcagctggtggttagggtgcataagataagacccagaaaggaagtcattgagttcattccaggaagcacaccctcacaactgccttagaaaccacacaggaccacatgtaaaagccatactgctcggatgacatcacatctctatttcttcccatggagtatgccgtttaaaaaagcaacatgtgaaacatggaattttaaagcttaattgattgtacaggactttatatctgctcaaccaaatctcttgaggaaaatagtatggaagacactagggaaaaaaaacacgcatacaaaataaagatttttatggcaggatccctaaacactggccagagagatgcaatcttggtgagactatagactggagtacttttggaccatgtagaacagcagcctattctggaccagatgcatttttctatctccttggctacatttcactctaatcctgccaactccagcttggcttaccatgctttctgattctcatgttccttgcagctgggtctgctagttgggtcctccctgcagtcacatgcctatcacaagatttggttaaccacaacagagaaaggagatatgtggggagacactgctacagatgctaggatctgtagttaatcttgtagccacctaactaattcatggaaactccagaaatgagactgcagtttctaaatcccgtatttctttattcagtccccaaacccaattgtttcggtcaagcacataagactagtcttctgactctgatgagtcatttttcttccctacagattctcctaaaaatccctcctatgaatcctctgctaaggatgctaagtgaaccctatcacatgtggctgcaggcctgacacagtgcctaagccttaaccttcctcttctcttaattctgtgctctcagctaaggttttgacaacttgccaacaccaaaactggaatacacaaagtatctgccctttcttggttgttacctatttcagagcaaactggacattcctcctctaaaattttatctatctgaattcaaaataagattgccatacttggattcttactctcattggttcagtcaatcacttgttcattcaggaaatgaaaatatgtcctacgcaaagctcttcagttgcttctaattgtttcaagagaaatatccaagttctcttgtatggattaaaaattgtttctctccatattttttttattaagcccaaggtagataaaaatgtggagactgctctgtagatattcataatatccataatcgcatcttcaaaatctatgaagagcccagagaaaacccatccgaaccaaagtaaattgtaattatctaattcctcagccttgctatgtttcttgggatttctccttattgagtccaaatttactaccatgactcacaacctaactgaagccacagaataaataactcagacacttgccaattcttccatcaagcggcccaataaagactctagtctctgtgagacttttaacaattaaatataaaattctctcaacattttttgagaaaagaccttagtcttcttttaaaagaaaatggaagggaaaatggtgcagcagaagggaaaacaatgccctccttctcagactgaataggagagaggtatttcaattatgatctgtgatgtacagtgataatatgatttgcaatgcttcttatggttcagagagaatactgacaaaggtcttgcgtttctgataccaatatttcaattttagatgcaatggaagatggctagagttcccattcctgctagaaaagagtgttgcttctgcctcaataagtaaagctggataaatagaaaaattgtaactttgctttaacccatcagagacctgagattacagggcaaataagtaggctggactccaatgaggaaaacactcctccaagggagacaggcagcttatggactggcacaactgcagcagagcatagaaaaagaaatgttatctgccatacaagcaagaaaaagaaactgggtaaaagattgagtgagagctatcatcagaatatagaactgctgggagttgcagacatagaaggagtttatattcactggtagggccatttcacagatgttggaagaagtaattaggggcagggtgagacacagagagagccccagcaaaagtgtaggcttacaagacataattggcagtcactgcaggaaagcacaaatcccagcattcttgcctaaatcagcctcttgcaggaggaaaagctttaagctgttggggatggggctaaagacctgacagcgcattctgtcaccccctagagcacaggttaagatccacaacagcaaagaaaagagtcaagggaaaaaaatctctacctttgggtagagacaggaaaccattctgagctgaagaccctgtaacaataccattctaattttgctacctgtaagaaagaagcagaaaactctctcacaccacacccacagagaaacacggcagtgtttggctgccacagggaggaaaggtatgaatgctgagaaaaccctaaatccaagatccaagcacatggggccagtctaagattgaagctggaccaagacaacagagaagtccacctacccacacagcgagcctcgtaagcactaaataacaagcaacggcaaactattgctagaggagtgaggggtgaggaacagaaagagagatcctctttgtgctgaaggaattcagggacagctaaaagctgaggtagagtactctaaaaaatagagattcataaatcaatagtaattcaagaagccagcttttaagtggctcacaaagcagtaagatggttttaggaaaacttatgtatttaaggatagtattctagaccttctattttcagatccttctacttcctactttctattcctggagacaacatggttggataccactatcagagccatattaggctgactgaaccaccattgtgacttgcattatattatcttctctcaattctttatctccgtggagttttaccttaaaagatgttcattcatatacttttattcactaggtataactatgaggaagctgataaaaagggatgtttctcattagtcttttgtttatctaagatttgttgtaggttctgatacattagcagaataatataatcaatactttgatttgtttatcagatctatctaggttcatatgctacctctttgtgttcttgaacttcttcgagtctttgaggattaaatgaaagaattgatatcaaattaaaagcacagtggttggcatgtggtaggcaccaataagccactaataacagctcttgaaatacgtcatatcctttcattgctcctttacaacattgagtttataacagggaaaaaaaataaatattattgcacagactccaagagactatggactgggactcgagtgcataacattttttacttgcaatgtacattgctgaaatctagacaccccaaacttcctgcatctgcttaggcttttcaatcacggaagaccactgcactctggcaggaaaaatatccagatgcctaacttggaaaataaactaaattaggccatcttgggaaatggcatatagctctttggagggcaactttatatttaccctgtcttctgatatgttgaataaaagaagtttaaatgagacatctgctttagtatttggcatattgatataggtgagctcttacactatgaaagtatattggaaaggatatgacaaagaatatgctgctaaaatccctgaaactcgttaacacttaaaagtggttgatttcaataataaatttcaggcatctcaggaactgatttcctcaaaagtatgatttatagccatctgattgtgaaggcatgaacatcctcattctttgacattaaaggagaaacttggcaattagagggagatgcatgggcttgattctagtcagtaaatggttcaggcagagacaatgacattaatctggggctttttatattggaaaacacaagccaagaaagaaggtgcaaatatctttgccataataatgctggtgttatgatttcacaagaagtaggtgtgaatatgttttactaatgaaaaaaatgcattcattcctcagatagactacaatgattggactatcaaaggaaaattagctttttaaatactaagttgtgtgttttcatgtacacgtatacacaagtcctggctgtagctttactgatacagagaaaacaaactgaaattgaagcactgacaattttcacctaccctctacctttttcatggcagcagagctcaccgtgtcttgcaaagttgttaatagctcaagcaaacaaagaccccattgatatccaatatatgtgcaagatcccattgatatccaatatattaaaaagggactttgatctgagctttattatcctgtagaatggagtgctaatgtcttgaagtacaatggagctagtataccaaatatcatgagcttaagaaccaatagagagggaaaaaatgagacaaggaaacaaaaattttgatgtgtgatggattctattggtctatccattgaagccttgctatatcaagataccttttaaatttatactgttcagaacgcatattgaaactgtcagtaaaaaagatctctctactcttccaacagagtccattgtatatttggtacaaaaataaaacatctaaggttgtattccattcttttgaatggaagctcagattaaagtcccttttaatgtcttgcacatatattagatatcaatgggatctttctgccagccagcagataattccccaatgcagatgaaacctgttttaaatagtacttctacttcagaaactagttactaaaaatctctttgggaaaaagtcaggcacataattgtgatgtgtgatggatttccttgtctcccaattttttctctccttggttcttaaaccgatgacatttagtataccagctccatggtacttcaggaccatgtacatcaatcctctctacaggataataaagctcagattaaagtctttttaaatgtcttgcacatatatcagatatcagtgggatctttctgccagttagcagataattcctcaatgtggatgaaacctgttttaaatagcacttctacttgagcctgagaggcggaggttgcagtgagctgagatcacaccactacactccagtctgggtgacggagtgagactcagtctcaaaaaaataaaaaatatatagcactcctacttcagaaagtagttattaaaatctctttgggacaaaactaggcacactgctctgaatacttcatgaaataataatttttccaacgcctttctgagccaggtgttcctggtgttactagaatgttggtcagttctgcacaaatttacctaatttacatcctaagatgctctaccttttctttgcaatagccatcaattatgccccaattttttaaaataaatctattgataatatcatggaactggatgaggaattctaatattaagtctgcatgccaattcgtccaattactcagtagaggaaagccttccaattgaacttcattgtgtgcctgcttttgtgcttcttttatttaagcattttgaatatatgagactactttagcccttctattccattctcatttccttttcatccagttaaacttattgagagcctaaaatagaaaattcaacacaggcagtcctaaatttccaaaagaagatttgcaactaatggtagaacaaagaagcaacaaatttttttttggacagttttacattattgcctgggctggagtgcaatggcacaatcttggctcactgcaacctccacctcccgggttcaagcgattctcctgcctcagcctcccaagtagctgggattacaggcacccgccaccactcctggcttattttttgtattttttagcagagatggggtttcactatgttggccaggctggtctcaaactcctgaccttgtgatctgcccaccttggcctcccaaagtgctgggattacaggcgtgagccactgcgcgcagctggaagaaacaatctttataatgtttcttaggaacaccatctgggctgggcatggtggctcacctgtaatcccagccctttaggaggctgaggtgggtggatcacttgaggtcaggagttcgaaaccagcctggccaatatggcgaaaccccatctctactaaaaagaaaataaaaaaattagccaggtgcagtggtgcatgcctgtaatcccagctacttggcaggctgaggcaggagaatcgattgaacccgggaagtggaggttgcggtgagccaagatcatgctacttcactccatccaccctgggcaacagaccaaaactccattaaaaaaaaaaacaaaacaaaacaccaccatctgtaagacatggttgaccagaaacagaataatgcaaggttggccaacatagccaaactcttctaagccatgagctctgcctctgtctcattgattggtgcctagctgctagagttcagtgataaaagtgaaatcaaaggctgtacattatttattttctttgactatgagtttatctttcctgccagatccaaaatgactaataaaatgagagatacagtcagtctagactcgaaccaggaagagtctctaaaatccaaatgagtaactctaatggtctctctgaagactctgcactgttgcttctttaaagataaacattaaaatagaaacccgcatctctaataaaatatttgtctttcccagactttcttgagagtgagtctggagtgaccattttgtggtaacagatcatcatttggggttattatttaagcaccagttccctcatatttgtgctgtcagtcacttcctcaaagcttcccattcagtatgttttaacttaagactcagaaggacacattgatgataagaagtttctcagtgggtctgaagcttagctccaacactgcttgtcttagaatagagactttatcttactaggacaccaaagaagactgttactacatggcatgaatatctgcttcttctttatttaaaaaaaaaaagtgcagaaggcatcaatggataacattctctatgttttcatttgagtctagtagttttctgttcttactttgtactgtcaggctttttttccccttatatctaccttaaaccctataaagaactactacagatcagaaactttaaatgcaagatctgtaacttaatcaccagaaatataaaccagaaatatgactttctactaatttcctacttgtgaagtaagatgttctaagggataggcagacatgccagctctccttctaaagacagaatgtgtgttatacacgtggccttggcaattagaggtctgtacacaggatggcagcacttcattttcacatgcagagaaatggaatgttcaactctgttgggcagagcatagcttgtctcctattggcttatagccaggttaagaaagagcaagaatacactgagaatagaatatgttctccttcccagatagtatagatcattgatgattctaatggcaagaagaatggaaaagtccctgggagctttattcaaattcagctgaagcgtaagtgcagggcttctggaggggtccatcacaagtctggggaaggagggggattcattttagttctcccctggttttctgctgatactctgcaaagaaaacgtacattcggaaaatgacccagtaacccattttccttgtttcaacggtgatgactggccaagaaaaggatgtgatacagagttattcaaatctaaatgtctaggagagagaaatggccgttattaatgacagttatacagatggagctttgaattatttctgttggtacaagaagaaaacggggaaggccctaatatcttaatggagattcattcaaatgtggatagaaaacaggacagaaggctcactgtactgttgaataaaaatgctaaacatgtctccctgcatattacagccacccaaccaggagactcattcctgtacttctgtgcagtgagaacacagaactcttcaggcacctgcaacctgtactcaaacctgcaactgggagtccagtcacattctttgtctttgaacgggttttgggttagaatggtttaccataatgtgcttgtttctaaattgaaatgaatgcagaaatctaataattgtgattacaaaatcattacgtttaaagtaactcaaaatgagctggtatactttgtactaactccaatgtattcgagaggagaagtagtgttgttttaaatagatatgtaaataataaagataacctcattggaatatctgaggttgtttcattgagatcctacacttccataataaaacaaggacacctaaaactcttctgggtggcaatctgctggccttcagaaaaaaaaagaagattcatttttgaaaaaattttaaaatttttaaatcatcatattttaaaatcatcacacactcattatttattataagtattttcattccaggtgtgtctgcatatgccctaattcatagcaacttaacatatcaagtatatttatcatataacatttatgtccattctcctctggacatccaccttcatagtacgggtattcagtcataaaagttacaattcaaatagccaccagaagaattcctgcaaagatttttgtcttgcaactgttctacattcagaaaatatttaccaactgcctactctgtgccagacattgttcttggtgttgaggattgagcaggatgaacagaaagacatgacaaaatttaattgtattctgcttctctcctccaatggatgtctgctcaccagaaattaactggggaaacattttgatgacagtgtatatccagggatcaatgacaccacctaggagttttaggattttgcccaaattcaccaattccttcatacctcataggtctgtatgtacagtagcaacagtgtgatctttctcttttttccaatgttccttcaagaaaggaagataatagttattttagtcaaactgttcaaaatagagaaaaaaacctaccaactccctcatgaggcaaaaaacataaacaaaatctgtagagttaagagtagtgaggctgggcactgtggctcatgcctttaatcctaccactttgggaggccgaggcgggtagatcacttgaggtcaggagttcgagaccaaacttcccaacatggtgcaaccccatctctactgaaaatataaaaattagctgggcgtagtggtgtggacctgtaatctcagctactcaggaggctgaggcaggagaatcgcttgactctggaaggcagaggttgcagtgagccgagatcctgcctctgcactccagactgggtgacagtgcaagattccatctcaaaaaaaaaaaagagaaagtatttttcatataaattattctcggatttttgaataagtaataagtatacatggtataaaataaaaattatacaaaaagatatatagtgaaaagtaacttttctctttacctctatccccactatccccaacagcctagtataaccactgttacactgaaattttctttgaacattatacatatatacatatatatgatgtgtatatatatatatgtatatataaaaatgatgtatgtatatatgcttgtgggtatatatataacatatatattaatgtagcataccatccacactgttctgttaccatgctttcttacttaaactatatcatgggaaaccatcattgtcagtacatgaagacagctaccttattatttttaatctaaattttcaaacacacacaaactaggaagaattgtataatgaactcctttgtatctttcattcagctttaacaaccatcaactggctatctccttctctttaaagtttcaaattttgccattgtgtgactataccacattttatttagtcaatctcttgttgatggacacagattgtgttcaaattattagttttgtttgtattgtagcatagtttagtaaggtacacagatctcaagagtacagttcaatgagttctgacaaatgtatatgccatacaaccatcactgaaactaaaatatagaacatttcccataatcctgaaaactctctcatgtttcccccccagacaacacttccactaaagtaagaattgttcttatttacataaaaccatagaatagttctgtttattctattttgataaattgagatataattcacatagcataaaatccatgcttttgaagtataccattcagttatttttaatatcatcacaaatctgtgcaaccatcacaactaattcctaaactttatcatcactcgccaaaaaaaaaaaaaatcatacctattataagtcactctcatcccctcctcagcacatctgcccctaacaacgccttaatctgctttctgtctctatggcctatcctagatatttcatacatatggaattgtacaatatgtgacctatcatgtcacgtattgtatgattcacatattcacatattttactggctttttcacttaccataataatttcaaggctgaacatttgtgaccaagtttttgtgtggacatacgtttttagtatttggggtattatgcataaaaatggaattgtgggtcatatggtaattttatgtttaactttctgaggaactgccaaactatttttcaatgtggcttcactactttacattactgtcagcagtaagggaggattccaatttttccacattctcatttgttattgtccgtctttttaattagacccatcttagtaggcataaagtagtatccctctgtggttttcacttgcaattccctaatgactaataaggctaagcctatcttcatgtgcttaatggccatttgtgtacctgctttagaaaatgtctgctcaagtatttgggctgtttttaattgggttgtcttcttattgttgagttgtaagaattctttatatgttctggatactagacttttatgagacatatgattggcaaatagatgctcccattctatagattatgttttttttttttgctttcttaatagtgttttttgaagcagaagtgttctaaattttaatgaagtctaatttatctattttttctttagttgctggtgctttatatgtcatatttttaaaaacattgcctaatccaaggtcacagatagttatatctatgttttctaagagtttcatagtttcagtttgtacattgaggttattgctccacttcaagttaatttttgaatatggtgagaagtagggatgaaagttcattcttttgcatgtgaataataagacatttggagtccccaaccaaaagaaagctgggtagctatactaatatcagataaaattgacattaaaccaggaattattactagagacacagagcaacacatcaaaatgattgagtacgatctacccagaacaaattctatttttatatatacctaatggcgtagcttcaaaatatatcaaacataaatcagtagagttgaccagtagaattaaattggtagaatttattgattaaaagatcaataaataattatacaaccatcatgtcaggcattaacacacatctctcagtagaaaagtattgaaattatgaccaacacaactaatatcctttacctcacatacatagattgaatactttacctcaaaagaacagattacacaaggaatatttagcaaaattgactatattctgaaacataaagtaagccttaatcaatttcaaagaacttaaatcattcagaatagtcatagtctctgaccatatggtattaagcaaaaattcaataacaaaatgattattaaactttattcctgtaccttgctagatataaggttaatttttcaaatgtattgccacagaaaacaccaagacaaaacagagatttggggtagggtagatttttcagtctctgaatagagcaatgtaacatactacttgcacactttatttcctgtttgggggcagaaacactgaacttctccagggactttgcactcaggcactcagagaagcattttgtttccaggcttgagtgaggaagcaaatttcaaccataagaagaaattctaccatgctctgccctggcctgctgtgggcattcgtggtcccctttggcttcagtacctatgggcggccccaaacatgggactgcagcttcctcgagagctgggctgcacaaattggaactggtggagtattaagtaagaggtaagggaagtggggaaatgaaacactatttaattattttctttgtccttttgccataaattaatctagtcctcatgacccatctgagacatttaagggaaccaactctgttttctcctttttcccataggatccagcatggctcagaaagtaacccaagttcagaccacagtaactaggcagaaaggagtagctgtgaccttggactgcatgtttgaaaccagatagaattcgtacactttatactggtacaagcaacaagcaacctcccagtgaagagatggttttccttattcatcagggttattctaagtcaaatgcaaagcctgtgaactttgaaaaaaagaaaaagttcatcaacctcaccatcaattccttaaaactgactcagccaagtacttctgtgctctcaggaatcccacagaagtagaaatgacagtggaagataaacaaaaaccttagcactccataaaggaagccacctgctcaggagcttagggaaaatacatgaagcacagacaggaagaaggcacattagtggcacagttgagaccttataatgtaaacattcctctgtaaaaaaaaagtttccttattgagtttatatataaagcagcattctttcttgcgatttccaactattacgtttctatcttgggttaaagtaaatcacaaagtgtattagtcagggttctctagagagacagaactaataggagagttgtatgtatgaaggggagtttattaaggagtattgactcacacaatcgaaaggtgaagtctcacattaggccgtctgcaagctgaggagcaacgaagatagtcggagtcccaaaacctcaaaagtagggaagccgacagtgcagccttccatttgcggtcaaaggtccgagagctcctggcaaaccactgctgtaagcccaagagtccaaaagctgaagaacttggagcctgatgtttgagggcaagaagcatctggcatgggagaaagatgaaggatggaagacttaacccgtcaagtccttccacattcctctgcctgcttttatcctagttgagttggcaactgattagatggtgcccacccagattaagggtgggtcagcctctcccagtgcagactcaactattaatttcctttggcaacaccctcacagacacacccaggaacaatactttgcatccttcaatccaatcaagttgacactcactattaaccatcatacaaagtgctttttaaaatcgttgctgaacaataagattaaatgaacctatgtatttcatgaaattcagaagcagtttgctgattctcatcttaaactgttgaatttccagatttgaagtagcactataaaccattttatcttccaatctcatgttgattttagcagtttttataaatattatcattttatttatttatatattttatatataaacaaatttcataaatacataaatttacttttatgtattttaatatataaatacatggtttttattgtattcagatagataagaaggcaattaatgttttgaaagaaatggatgaccaaaagaagctttgactaaaacaaactatgattgttagagatagaaaataattcttgggtgcttcataagcccagcagaaggtgggctgagaaaccaatttatccaccaaggcaggcatattccttaatatgtggtcaaaggagataagagaaaaagaatattccagaggactgagccagagaatgtaaaaaacaatgggcaaaataactccctgcatagagtgcagtcagaatctcatcaaagcagggtaggggtcttcataataatccaaaatgaactaggtatgtgcagaaaataattaacagtttttgtaacacactgagattttggagttgattattgtagcaggataacctagttactcaacttatctaaatacagagaaaaaatgagaaaatgttttcccaatttattttacaaggccagcatgattttgatactaaacctgaataaagaaatattttttaaaaaattattatgggataatctcactaaatgaacataaattcaaaaattctaaacaaactattagtaaaaagaattagcagttataaaaaagaataacatatcacaaccaagttgggttttatataatctttatataacatcttaaatgaattaaagtaataattctcattaataaaaacatgatttaataatctcaacagttacacaaaagtttttaatacaaagtaaatattcattcataataaagagataaatttatggcaaattaggaatagaaaaaaaagtcctcattctgctaaattatatgtattacaacaaagcagacataaaacttaatgaaaaatgttgaatgctttatttcaagaaagccaaaaaaacgctatccctattaaaaaagtatactgaaggtcctaaccaatatttaagaaaaataaagaaataaaagttttaataattagaaacaagactataaatattagccacagatggcatgactgtgatatatacaattccaaatcatttgcaaatatatattacattactgagtttagctatgtagtattaaaaattacattttatatgaaagcaatcagaaattttaaatgaacctttaaaaagtgtccttaaaataggtggggtgaactgggggtggagggttacgcctgtaatcccagcactttgggaggccgaggtgggtggatcacgtgaggtcaggaattcaagaccagcctggccaacatggtgaaatcccatctctactaaaattacaaaaattagccaggcatgatggcccatgactgtaattctagccactcaggaggctgaagcaggagaatctcttgaagctgggaggcggaggccacagtgagccgagattatgccactgcactccagcctgggcgacagatcgagactcgtctcaaaaaataaaaataaaaaaataggtggggatgactaatgggtacaaaaaaactgcaaagaactaataggacctatcatttgatagcacaacagcgtgtctatagttaataataatttaattgtacattttaaaatcactaaaagagtacagttagattatttgtaacacaaaagataaatgcttgaggggatggatacctcgttctccatgatgtaaacttttttttttttaagaaagtctcactgcgtcacccaggctggagtgcagtggtgcgaccttggctcactgcaacctccgcctcccagattcaagtgattctggtgcctgtctcctgagtagctgagattacaggcaagtgccaccatgcccgggtaatttttgcatttttagtagagacagggtttcgtcatgttggctagactggtcttgaactctgacctcaagtgatcctcccgcctcagcctcccaaagtgctaggattacaggcgtgagccacatgcctggcctctatgatgtaattatgcattgcatgcctgtatcaagacatctcatgtgcctcataaatatatacacctacaatctacccacaaaaattaaaaattaaaaaatgtaacatgtatatatccttaaaatagcataaaaatacaaaatacttaaaaataaattttaaaagatatttgcaaggcctcaagacaaaaggctataaaacattaaaaaacgaaattaaagatctaaagaaatgggagaattcatcatgttcatgaattagaagatttacaatgcaaaggcatcaattctcgcatatttggtaaatacattcaatgaaatccccatcagtatcaagagtgtgtgtatatacaagtagattctaaaatatatagtttttaaaagtcagtaatactcaaagcactccgagagaagaagagcaataggaggacttcctgtccctgacaataagcctatgaaatttaaaatatggtatggaggaacaggaacacactcagttacagatctcgtcagctgtgtgtgttcctttttcctctcatatccactctccacctttctcttccttgctgtttgtctcacgaggctgacctgaatgaaccgcatcaacaaggctcccgtgccctctgggttctagtggatttttgccagtgaggtgccctttgccaaaatctgaaaaaggtagcagagtaaggtcagggtgtttgttccttggttctcctcctgaggaatctcttctagtggcaaacatcatttgttcaaagatcacagctcctttcaacttggctctctccacacacccatctccattcaggttttgatattcctctctgccctctggacatagggatagtaaaactccactggcctaaagataataaaattaaaatgcagatatttctcaaaaatctcatagagaaagaagtctgaggattcaggtaaatgggaatgtggtaatggaattatctgatgcaatttaatcagatgcctgctaaccatactccctgggaatcccagaggacccttctttcaccaaggaatcaggaaattcatcattgagtgggtcaccagaattcttaaaatatttcttggaggccatccaacctctatacagtgaaggcaatggggacggggtgggcacattgccatgtaatttgctttcctggatttcagtgggtgtgactggatcctgttgcgataggtagtggagtttaacagatagagacaaagatagagtttaacagatagagaaagagtattaatcagagtcttttaacattcagagatttttggagaaagctaattaatcatagaatacctaggaaggaaagacagaatcagcttcctgaggctctactttatattatctagattttttgaggaaaaaaatatagttttagtagctataatggagattaataggcccttaatcaatcccaattgagaggcctaaaacatctgaactgagggaatggttgcatccatttgagaaagattatgccagacaatatcaagcattggcaaggatatggaacaactgaagctcttatatatttattatgttggcgctaggaatgtaaaattgtgccaccactttgaaaaatggtttagcaatttttataaagttaagcatgcatatactgtatgatctaataatttgcacccatagattgttaaccagaagaaataaaaaatatatattcacagaagtatttatgcagaatgtatttgtgaatagaaaatattcacataatattgtttatttcttttggataaatattcagaggtgctttattcattataggtcataactggaaaaaaataaataggaatgagcaatttatatatacaataacatggatgcattttaaaaacattacatggagaaaaatgtcagatgaaaagagtttatactgtttgtatccattaatttgaaactcgaggaacagcaaatttaatccatattgagagaaaacagatcagtggttgtctggattctgcagttggggaacccagacaaccactgattgacaggtagagaacacagaggaacaatttagggtgaaataattgttctgtgtcttgatttatacaacagttacatgttctataaatatttcaaaactcaccatatttcaaagcacttaaaatgggttcattttactgcatgtaattcatacctcaataatgttgatttttttaaaagaaataataaatattgctacatgccaaccaaaatgtctaaaattaaaaaagaaagacagagctaagtaatgaagagaatttgaatctactcaaacaagtaagagtgtaaattgataccaatacttaggaaaattgtttaacactaatttctcaatttgaatcataactgatgaaaattattttttaaaaagccaaagtctgggaaatcgtcctaagggcataccaaaaatggagaagcatttattcaagaaaatctactgaatctactaaatgtcagcaaacaaaaataaataagatgtgatatatatgtatacacacacacatataatagaatattattcagcctaaaaaggctgtttttatggatacaggttcctttttgggatgaggaaaatgttctaaaattgattgtggtgatggctgcacaactctgtgaatatactgaaaaacattgagttgtacactttaaatgggtgaattacatggtatgtaaattgtatcttaatgaagctgttacataaaaataaaaaagcaaagcaaaaggtaccacaatatttattgttcttttctagactcagtctggattctccataccatttgaatattgcagtaatgaacactatatgtttgacttttgtataatataactagataacatagagacatctacatttcatatttcttttcacaatcccaattttttaaacctatatatttataccagtactgaattattagtgtcatttttaatctgacacatatataacatgacacagtgaacagctgtcaaattaagtgtcactatatggctattgtgtcatatatggtcatattctaataaccagtctttatgtattatagatttgtgaatttttcttttttggaggatggagaataaggtttggtgtgctatttgaattttgctcacagatctaatctggcattttcacttttacttttagatagttttgttcaatttgttttcaaaaaaattagaagctttttgggggaacaattgcaagagtcattccatataatttctcccaataatgttatgagtaaataaaaattaatatattcacccaacaaattaagttctcaatctgtgccaaatcctatgctatacaatgagtaacatgagctttgggaactgccttcaaacatgtgaagaaccagataccacagaaaacaaaaggaatacattaattgagaaaacatcacataaataattttggggggggcttcctttattttattttattaaaaaaattttaaataggtttttggggaacaggtgctgtttggttacatgaataagttctttagtggtgatttctgagattttggtgcacccatcacccaagcagtgttcactgtacccaatgtgttgtcttttatccttcaccactcccacaccttcccccgagtcctcaaagtccaatgtaccattctcatgcctttgtgtcttagagtttagctcccacatatgagtgagaatgtacgatgcttggttttccattcctgagctacttcatgatatggtttggctgtgtccccatcaaattctcattttgaatttccatgtcttgtgggagagacctggtgggaggtaattgaatgatgcgggcagggctttcccatgctgttctcatgatagtaaataagtctcataagatctgatggttttaaaaggtgttcccctgcacaagctgtctcattttttgcctgccaccatccatgcaagatgtgacttgctcttccttgccttctgccatgattgtgagacttccccagccaggtgaaactgtaagtccaattaaacctctttcttttgtaaattgcccagtctctggtatgtctttatcagcagcatgaaaatgggctaacatagcatattggtaccagcagagtggagcattgaagaaaagatgcttgaaaatgtggaagtgaccttggaactgggtaacaggtgcaggctggaacagtttggagggctcagaagaagacaggaaaatgtgggaaagtttggagcttcctagagacttgttaaatggctttgacaaacatgctgatagtgatgtaaacaatatcatcttccaggataaggtggtctcaggtggagataaggaacttgcttggaactagagcaaaggtgactttgtcatgttttagcaaagagactgttggcattttgcccctgccctggagatttgtggaacattgaacttgagagagatgatttacagtatctggcagaagaaattcctaagcaccaaagcattcaagaggtgacctgggtgctgttaaaagcattcagttttataagggaagcagagcataaaagtttggaaaatttgcagcctgacaatgcaatagaaaaggaaatcccattttctgaggagaaattcaagccataatgaagatccaaatgttaatcctcaagacaaatggggaaaacgtctccaggttatgccagaggtcttcacagcagcccctcccatcacaggcctgaaggcctcagaggaaaacgtggtttcatgggctgggcccagggtcctcatgctgtgtgcagcttaggaacttggtgctctgcattctggctgctccagccatggctgaaaggggccaacatagagctcaggccatggcttcagagggtgcaagcctcaagccttggcagcttccacttggtggtgagcctgcaagtgcacagaagtcaagaattgaggtttgggaacctccacctagatttcagaagatgtatggaaacgcctggatgtccaggcagaagtttgctgcaggggcagggctctcgtggagaacttctgctagggcagtgttgaagggaaatgtgggattggacccccacacagagcttctactggagcactgcctagtggagcagttagaagagggccaacatcctccagaccccagaatggtacatccactgacagtttacaccacacacttagaaaagctacagatactcaatgccagcctatgaaagcagccagtagggaggctgtaccctgcaaagccacaggggtggagctgcctaagaccatgggagcccacctcttacatcagtgtgacttggatgtgagacatggagtcaagcgagatcattttggagctttatgatttgactgcaccgctggattttggactcgcatggggtctatagcccctttgttttggccaatttctcccatttggaatggctgtatttacccaatgtctgtaccctcactgtatctaggaagtaacaaacctgcttttgattttacaggctcataggtggaagggacttgccttgtctcggatgagactttagactgtggacttttgagttaatgctgaaataagttaagactttgggggactgttgggaaggtatgattagttttgaaatgcaaggaagtgatatttgggaagggtcggggtggaagtatatggtttggctgtgtccccacccaaatctcatcttgaattcctatgtgttgtgggagggacccagtgggaggtaattgaataatgcgggcaagtctttcccatgctgttctcatgatagtgaataagtctcacaagatctgatggttttaaaaagaggcattcccctgcacaagctctctctcattttttgcttgccactatccatgtaagacatgacttgctctttcttgccttacgccatgattgagaggctttcccagccatatggaactataagtccaattaaacctctttctttgtaaattgcccagtctcgggtgtgtctttatcagcaccgtgaaaacagatgaatacacttcacttagaataataatctccatttccatctacgttgctgcaaatgccattattttgttcttttttatggctgggttgtattccatggtatatatataccacattttctttattctgtcattgattgatgggcatttgggctggttccatatttttgcaattgcaagttgtgctgctataaacatgcatgtgcaagtatcttttttgtacaatgacttcttttcctctgggtaaatacctagtagtgggattgctggatcaaacagtagatctacttttagttctttaaggaatctccacactgtttttcatagtggttgtactagattacattcccatcaacagtgtaaaagtgttcccttttcactgcatccaaaccaatgggtatttttttaaatttttttattatgaccattattgcaggagtgaggtggtatcacattgtggttttgatttgcatttccctgataaataatgaggttgagcatttccagatgcttgtgggccattggtatatcttttctgagaattgtctagtcatgtccttagctcactttttgatgggattgtttgttttttcttgctgatttgagtcattgagttagattctcgatattagtcctttgtcagatgtatagattgtgaagattttctcccactctgtgggttgtctgtcaactctgctgattgtttcttttgctgtgcagaagctttttagtttaattaggtcccatctatatatctttgttcttgttacatttgcgtttgggttcttggtcatgaagtctttgcctaagccagtgtctagaagggtttttctgatggtatcttctagaatttttatggttttaggtcttagatttaagtccttgattcatcttgagttgatttttgcataaggtgagagatgaggatccagtttaattcttctacatgtggctagccaattatcccacaaccatttattgaatagggtgtcccttccccacattatgtttttgtttggtttgtcaaagatcagttggctgtaagaatttggcttcatttctggcttctctattctgttccattggtctaggtgcctatttttatactagtaccatgctgttttggtgactatggcattagagcatagcctgaagttgggtaatgtgatgcttccagatttgttcttttttggttagtcttgctttggcaatgtgggctcttttttgtttccttatgaattttaggaaataattctaaaaccccaaagtgactgaaaataatttgatctttcttagagaattatggtaggaagctctttgctgagccttgtcactagagggaggtagcacatccaaaataatctatctttagacctgaaacacaaaccctgaaagattgctaactgacttggttcctagttctatgtaaaggagttcacatatacagtcacaagagggagctgttacagctgcaaatccaagctccttccagggtgagcgaggttgtcattgagttgtataaggaatttatgttcattctttttgccaccttgtgctttattatctctttttgagtgtgtgcacagtttcaaagacatgggtaagccccttcccaaatgcagagcagaagtgaccctgaatgggaaaaacagagaagtgattaatacatagctcaattttaaatggtgaaatatttgttgctataatggactgacaagcttagttattgtagcagagataatgagtaattttaattttattccttcccatttctttaataaccacttttgaaaataactagaaaaaccccttcatagttacttctacctctcttatcaaatggcatcatttgatttccctctccaaacctcttcccatttcttcctttctccttcaatgtatgccactcctaggcatcatgaagatgagaaagcatatgttaaagaggagttcaagtggcatagaaataggggtcattcaagccattggctcctgtctcaaaaccagaggcacaggcaatgtctatctagaagacacttaggacattattccaggagccagtgtgggagacctgagtaccaggaaacttggcttctaacctgagttctaaatttgttctttcctttcacacttagcacagcaatattatacaattatgaaattacttttgttatatatgttgcaaataccttctttcattgtgtcatttgattttcaattttgcttatggtaattttttttaccaaaaagaagtttctaactgttgaaattaaattatatgctactgcttcttctaagacttactcgccctgaagatgtggatagaaattcccttctttcccttacagcacagggctcacatagacttcttggaataaagggctgttcttaccagctcaatgggttgtcaaactaccaattaatggtgggttttgtccttaccataataagggatgggtaatcccatttacttctttagatgtagcctacttgagtttcagccttgaaaatgatcttaatggaaactttctgaattaaagctagatttaaagaaaatattcttcccctctttttaaagttttatttttttaattaacaaataataatcgtattttatcttcttttaaaatgtatgtttaaacctgggggtgggctagacctaaccaggaagctgctctatctttagctgacgatttctggggagcactcaaattgaaacctgcctgatgtgggatgtgctgtggctgctgctttgttgcttgggacctcctctgacctaggatcagacacagagtctgagttctggggcctggaacctcaatgtgcacttgaacaatgaagttggtgacaagcattactgtactcctatctttgggtaagtgttctgggcctaagaaagcatagttttgtggctaatgacaaaagagagttatctgctgtctccatgttttctaccatgatttaccaattgcgggaaaaaatttgtttctatgtgtttcttgagggtgtctgagcgtcagtgtgaggggttggtcatatccactactcagagaagattctccaggtctcacagctctcaagctgtaaggagttttaggttcattgagctcaagggtcatggaagatgggaaatttatttttggccttgtggctctgcatagctcaggaacaaataaataccagtaatatttatcttgtcctgtgcaacacacataaaaacactcaaatatggagtagggcagggaggacagttctggagcagtggtgaacctgaccttcagatgcaccaagagctgatgatccagagctaatctgctgtttttcaaccccataggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagaccacagtgggacagatggggctgcagctgtgcaatatctccctggtgatgaaagggaaggcatctaacgaggccactgcacaagaaggagcagaagtttaatagaggaagaagaaaatttaaagaagaaaagggaaaagaagtaaagaggaggtggtaaggaaatcaatgagaggatgagaggattaaaggaatgaagaaactgagaaagaatagctaagaagtcctgaagaaaggactgagaagcttggcgaagagatgaagaatcacaattggaattctgcagtcaggaagaaaggaaataagaattttcccggacgctttcttttaatcaactcttgctttccatgtagacctcactataaaagatgagaaccatcatctggtagtcccaaagcatttcttcatctagccccaggcaagtgcctgggctttgaatattatatcacattagtccttccaacctctcaataattgaaatgaatttcagaaattgattcatttgcccttacgaaaaatttgaaattttatttgttactcatccatagcacatactcttgggatatagatgatttctggaagggagcaagaaagtggtggatatgtgaatattgatttcattttttaaatctatgttgaaatatctctattattaaacaaaaatacacaaatcttttttcattgtaaaagattcaaactattaagtatgcgaagtaaaaccttagaggcccaaactgactgtctccatctccatcccattttctcttcaattcctacaataacccattttgacagtttggagagtgccctgatgatcatactccttttcatttatgtggatactcacataaatatctacccaattttattacataagttggaacataccatgtgtatttgtctgcaacttgcttttatttttatttaaaaatagttttttgaggtgtgttcataccgagatacatgtgtatgcatgtgtgtataaactggccttattcttttcaatatctacaaatgttcacagtatggttgtataataattttacttacctcacctatatcatctctacatatataaatatatatgacatatgtgtatgtgtgtgtgtatgtgtgtgtgtgtacatattccttatagattccgaagtggaattactggatcaaaagatatgcctattttatatttttatagatattgaaaagttgcattccaaaatggctttaacagtctaacccaagatcaggaacatggcaaaaatgtctactctcaccgtttctattcaacattatcctagagaatctaaccaatgcaatgagacaaaaagaaaaaggaaaccaggctttacctattacagatttgtgagtttttcttttttggaggatggagaatgagggttggtgtgctatttgaatttttcccacagatctaatctggcatttgcctttactttggatacttctgttcaatttgttttcaaaaaattggaagcttttttggaataatttcaagagtcgttccacataacttctcctaataatgttatgagtaaatagtaattaatatattcacccaacaaattaaatctttaatctgtgccaaatcctatgctgtacaatgaatgacatgggctttgggaactgccttcaaacatgggaagaacaagataccacggaaaacaaaaggaatataataattgagaaaacaacacagaaataattataaaagctccgaagtgactgaaaataattctgtctttcttagggaattgtggtagcaagctctttgctaagccttgttcctagagggaggtagcacatccaaaataatctatctttagacctgaaacacaaaaccctgaaagatcgctaacttgactttatggtaaaggaaaccatatttaactttttaaaacgtaactcattttgcaaacaatagaattgtctgtgtagcaaatcctatagacaaaaaaactactgtaaccaataaatgagttagataaaattgcaagatacaagctcaatatacaaaataatgctgcttccatacagtaacactaaacaagcagaattgaaatttatatagatatgcatatgtatatttatgcatttatatatttatgcatacatatgcataaaaaacttttaacaaaattttagcagactgaatctaacaatatataaaaaggataatacataataatgaagtggggttcgtctcaagaatgcaatttatatgtatatgaatttcaattctgggccaggcacaggggctcatgcctgtaatcttggcactttgggaggctgaggcaggcagatagcttgaggccaggaattcaagactagcatggccaacatggcaaaaccctgtctcgactaaaaatgaaaaattagccaggtgtggtggcacacacctgtaatcccagctactcaggaggctgaggcacgagaatcactggaacctggggggcagaggttgcagtaagccaagattacaccactgcattccagcctgggcaacagagtgagactctgtctcaaataaataaataaataaatttcaattctggcgtgtgtgtgtgtgtgtgtgtatgaatacacttgacagaagttgtctaaggcctgtacactaaaagatataaaaaaattctgagatacatttaagatctaaataaatggaaagagttattgtgtttgcagattagaagactcattaaaattctctccaaattgacctacagattcaatgtcattcaaatcaaaatcccaacagaaattttcatagaaattgacaagtgggtctaagatttatatgaaaatgccaagggactacaacaaaaaaattctttttaaaaaacacaaattgaggaacttacactactgatatgaatacttttatagttacaataatcaagagactatgatattgatataaagatagacaagtagaacattggaacacaataaaggatccaataataggccagcatgtacatagttgattttcaacaaaaataccacaacaatttgttatgaactgaatatttgtgatctcccctgcaaattcatgtgttgaaatcctaacccccagtgtgatggtattaggaagtaggtctttgaggaagtgattaggtcataaaagtgtagccatcttgaatgggattagttccattcagtgaaaccctagagaactttcttgttctttctgtcatgtgaggacaccacaagaagactgccatctatgaaccaggaagcaggccctcaccagacatgagatcttccagcccctcgatcttagacttcccagccttcagaaccatgagaaataaatttccattgttttagtcacacagtctatggtattttgttatggcagcccaagctaacaaacacaatctcaaaataaatatgctgaaagaaaccggacgacagaaagcagatacggtatgattctgtttacataaaactctagaaaatctatagtaagagaaggcagactagagattgcctggggttgaataggcattgggatgatatattggaaaggtatacagaaaggattaacaaggaacacaaggaatagagacacaaggaaactttggggagtggtgcatatgttctttatcttgattgtgatgatgatttcacatttgtatgaccatgtcaaaaattatcatattggaccttgtaaacatatgtaatttgttatatgcaaagtgtacctcagaaaagtagtttttaagaaggctcaaaacaaaagtagacagagataaatattgaaaaataatcactctgtactatagagaacagaattttttactttctcttaattatggagggtaaactttctcaagcatgcaagggtaacatatgttatgagattatattttctttatctcataagtggcatattttaatgcaataaatagatctatgtcatatataaattaactccagaaaacctgtccattattcagcatttctcagtctggccaaagagtggcagtgttaaaaaagtatttgagtaagattgtacagtgctgaacaaacaggaatccaggtatggcttctgattggtgcaatctcctgcaccaatgagcaaagtaacttctgctggggaagctcattcagtaaaatctgatttaactgtgttttctaaatagctaagggatggagactgttctgcaagtactcctagggatattggggttccaagcagcctgtgagtatgtggttagtctgggagaattgcgagatggtgacagcatcctgagggcaagagtcgagtcatcttctgttctgggaaggcccgtttgagagccagatatgtgttgggaaaaaaaatgacaatactttgttttaatgtgacaattctgctgcctaggggaagtggggagggggagaaaaacatcatccctaccatgaccatgaaaatcttatgagggtcttctgtattttctttacattgtctttttgaacaggggtcagtagccaagaactggagcagagtcctcagtccttgatcgtccaagagggaaagaatctcaccataaactgcacgtcatcaaagacgttatatggcttatactggtataagcaaaagtatggtgaaggtcttatcttcttgatgatgctacagaaaggtggggaagagaaaagtcatgaaaagataactgccaagttggatgagaaaaagcagcaaagttccctgcatatcacagcctcccagcccagccatgcaggcatctacctctgtggagcagacacacagcgatcttcaggcctctatcagctgtctccaaacctgcagctgggccacatatgctcttctgacatggggctcctgagatgtggctgggacctttgccaagacatgaagtctcagaacgttgcaattgtcttattggaaaaatggggaggagagtaggaatgatacaagggggagctatatcactaatcccaaatttaatttgactttattgtctggtagttatgttactttttagtagatggaacatcaaattcgaatgagaatagcatgaatttcagtgatttatgcaagaactatgcacgaatattatgtccctgttgtgccaaggaacttctttccctttgctatttacccaccttgttaataaaaagaaattgtgcattgtttgtcagattctttgtcacagattaacattgtaccaagagtgttagaatatccatactgaggagtcatgggcaatagttttttctaagtttgtagtatagatatagaaaaagacaaatgtttagacagataaataggtgatagatagattataggaagctagattattagatagatgataggtagatagatagataataggtagattagatagagtgagctagagagaggggaatatattaataaatatctaatgcagtcttagactggcctccacttctcttctcattgtgctttcattcatattctagtctcagtattcttctggccactccaaattatcagcttaaagaattgtttcccagttgtctcagtatgaagtggagaagatgttaccttcatcctccactccacatcagaatagtgctggcctacagtgggtgtttacaagtattaaactgatactgaataactgataagatcataggttagagagaaataattcacatgtttcttaaaagctatgtgatgttgaccaacaactttaactttacaagtctttattttccctctgtaaagatgatacaatcatattattttattcatatgttcttgttaggatgaagtaaggttatagattacatacattaagtatctggtgtattgcaagccctcaatatttgagatagtatttttactattaatcaaacaatgacaatttcaagtaagtcaaaattctcacataaaagtagggaagttgatcaacatgatatggcttcaacctaactaggagatgttctattctttaaatttagaaaagaaaggaggaatataatggtctcctgtcatcagaaactgcctagtgacctggtttcaaaagaaattgcatgtaaaatgggaatgatcatttatgttggccaaagtcagggaagatttttaaaaatcaagtcgaattagattattttctgttttaaagaaatgttacctataccacccactgggagaaaagtttgctaaaataaacaggaaagagagaaaagagagaagcccatgaaagaaaatgtttggcaacgtgataagaggaaaagcaagcaggaaataagaacataagtttctgattttcatgaaatgttccgagtaaagtgacacttacctatgtgtgtaaatatgcatatacatatacaaatctcaaactaaagagtgtacatatttgcattttaacctaaaatcaaatttttctaattggaaaataatataaagatattgtctccagtagaatgctgggaatattaagggttgaaagtatgaagataagtagtcataaggatgtttagagattaacctgccatgtcccacaaggctggtaaatcaatgttatcaggagaaagaaactgttaaattcacatcagcgtcttaggtcagcctaagcaaataggttatatgacatgcaacttacccttctcctctttttttctcccccatcaaaagccaatttcctattctgagaaaataattcaccttctccagtgattctgcctcagaatgtccagcaaactgaacaaggctgagctccagacattggttttgattctgggcagcagaaatttccctatgggagaagatgccagcatgacttttcctagtgtgcaatgagcagcgaccagctctgtctacctccttagggatagcccctgataggaatgctggggttgagcaagaggaagagtgagtgattagaagaaagaaggcaggaaccgagtttcttttcctcctgccttgagtgcaaggtttagttccttttctaacagctcttggcaattccattataaatcaggtgaaagaattagtctgatttttgtttgtttgtagggcctagcatgtcatagaaagccactaaattctaatcagcaatatctggacagtaagggagattgtgaacttagttttcttacaggacataggtattataattattattgtggtaaaaatttcctcctagcaggaagataatttttttgtgtgctttgggaatcacccaaaagttttccactgcaaaaaccaatggaataaggaactgatattttctaaaccttcagtaagtggctaaatctatcaggcttatctattcacccccatagtgagaattccttgcaatatgtgtttgtggcattcttatagataccacagtcagaaaaaaaggggatggattaaaataagcagaaaaatttgctacattctgtgctaactttaaccccatataaatgctgtcttataagtagatctattaaatagggccatccatagccacagcctttcatattttaagtaaatatcacaacataatattttcatcagaaaacttgtctccaatttctagagccttttgttactcctggcactatcttagtaggactttagtgtgccagatatgagcctgctagatttaagtcaaataatgatttattcttatgccctcttctcaactgtgttgatcaaattcataaaacaaatgttagccttaaattccttacttcacttccttgtcttcacttcctctgggacatagtcttgtcttgtctagtctagtcttatgctgcagccttgacaacttgccaagataaaaagttgagagttacgatagtagaaagaagagctacagagaataaacagaatgagaaagtataaaatatgattaaatggagttccagaaagaggagagaggtgaatgaggcagaaacaatatatgaagagataatggatgaacagtttttaaaaaatggatgaaagacatcaattcacaattcaagaagacaaaaacattcctgggcaatttatataaaaagaagtgtagtgtgtgtgcatgcatgcgtgcatgtgtgtgtgtgtgtgttcagagtaaaacagcagaaaatcttaaatcaagaagaaaatcttaaaaatcaaaggggagggtgaaaaagactgttttcaaagaagtaaactgacagctgacttctcaaaaataacaatggaaaccaactgagatttgaattatttttcaatgttcagagagaaaataactaacatcaaattttgtataaagcagagcaattcttaaaataagaaataaaagcatttaaagaaaatctgcagaatttaacggtatattttctctaaaggaaactccacaagtagatggaaaggatgagggcctggattatactgcacctgccacctgtgtggttgtgctcaaagaacagaacctctttgggatggtttctaaatttcaaaataaagatgaggtattctcagctagtctcactgtattttattaattgaaacaccatatgtgaaacagaagactctaatgcaaacgtaaagagatttgttactaaaaccttaggccaagctttggatgttcttaaaagggcaatggcaggaatgagaatggggaaaatgatctatcctcagtgagttgtaggacttagagaaagcctcaagggctgtcatgtgttttatcatgtcctgagaaacaggtttacaaatattagcacctccttactgtgctggataattctattcggtttcctccagcagtttgtgataccccctatgtgtagagtgggtatgtagggggcaaacaaaggactcatctgttcttgctgccggcaagctgtagccacatccagttggctctcacctcccaaatagcttcaaagagaagcaaatcatattcaacagtttttgtggcagaactcatcctgcagaatttttaaaaaacttgttttatcttatggcctttgataaaagttctgaacccagggccagttgtagcagaatatggacatatgaaaaatctgcctttagtctcttgccattccttcaccattgcctcccacctattctactgctcctgctttttacccagcccctagtagtattctatgatgttttaatactgttagcctgcccaaagcctgatatttctagtcactgaattgctcttcagaaccttctcctacactattgagtagatatatatctctctccactcaatctctaaaataaagtggtttatagcctaacttactctcaatgtaatgttctaggttaggtctccctggactgtttgtatttgaaaaagaggagattccaagaaagtctcctcaaagatacattctcagttacggtggcagtaggatagaaaagatgtttttattgtaaaatactctttcccacacttctcagccatagtgtaggctgccagtgtttggtcagttcccatcagcaggaacacaggcaacatactgttagcaattttttttttttttttttttttttgagaaggagtctcgctctgtcgccaggctggagtgcagtggtgccatctcagctcactgcaatctctgcctcctgggttcaagccattctcctgcatcagcctcctgagtagctgagattacaggcatgtgccaccacacccagctaatttttgtatttttagtagagacagggtttcaccatattggccaggatggtctcgatctctttgtcagcagtttttaaaacatatgtttttattccaattattttagaaagataacataattcagaggaaaaaattaaagattctattgcttgaaaatacatagaacaatattctatttaactacaccttgtctatgtttagatacacaaagactcaccattgttacaattacctagagtattcagtacaataacatcctgtgcaggtttgtagcccatagcctatcgtgtagcaggctataccatctagaccagtacgctcttataatgtttgcacaatggcaaaattgcctaatgatggatttctcagaacgcctgtagttgagcaaggcatgactatatcagtaaaacttctacatgaaagaataggcaggggaactagtttgtctaagaaaacatatgaaaatttaactgtttcagaggcagcacagtcaaaaaagtaaaggtttgtaatcttagatatcactcaaatactagtcctcctacttccaaaccagataaccttgggcatgtgactgaatctttctgaacttagattcatctgaaaaatgaataccatctatttcctagagtggtaaagagtcccatatgctacgggacttaggattgcttaggattgctaaggatagctttggctattcaagctcttttttggtcccatgttaattttagaattgttttttcaaattctgtaaaaatgaagttggagatatatgagataaacaatacacattacctgccacatattaactaatatatataacaaacattatgtaaatgacaaagagtactaggtactcccaggaccttttatgatcctcagaatatttttttgaggtaggtattattatcttgcttttattgatgagtaaactgattttcagagaagttaagtaacttgttcaaagtcatgcaattaagaagtggcagagatgtggtagtttttgtgatagaattcttttcctttccctgcctgttgaacggtctgcatttagacatttctttaaattattttcagtttctttcccttcgtccccacaaagagcactaaaggtcatggtaaggtaggatcatttgaatcatgttatgatcttcctaacatgaatgactcctggcttttccagttaacaggtagtggtccattatgctgtggttatattttctgcatgtatgatgatataacgtaactggccaggcacagtggctcatgcctataatcccagcacttttggaggctgaggcaggcagatcacctgaggtctggagttcaagaccagcctgaacaacatggagaaatgccatctctcctaaaaatacaaaattagctgggtgtggtggcacatgcctgtaatcccagctacttaggaggctgaggcaggagaattacttgaacccaggaggtggaggttgtgctgagccaagatcataccatttcactccagcctgggcaacaagagcaaaactctgtctcaaaaaaaaaaaaaagaaagaaagtaaccaaaagactgtcacttacttgccccatgacccctgttacatagcctttgaacctcagtttgtcatagaaaaatgaagaaaatagtctctcccatcctattgctttttactgtattaaatgtaaatgtatatggttctttaaatgttatgtattattcagatttattacaataattgttatgtaaatgacatctatctgataatagaatgaggtctggagttcaagaccagcttgaccaacacggagaaatgccatctctactaaaaatacaaaattagctgggtgtggtggtgcatgcctgtaatcccagctacttgggaggctgaggaaggagaatcacttgaacccaggaggtggaggttgtagtgagccgagattgcaccatttcactcctgcctgggcaacaagagcaaaactctgtctcaaaaaaaaaaaaaaaagaaagtaaccaaaagactgtcacttatttgccccatgacccctgttacatagcctttgaacctcagtttctcatagaaaaatgaagaatatagtatcttccatcctattgctttttactgtattaaatgttaatgtatatggttctttaaatgttatatattgtttacatttattacaataattgttatgtaaatgacatctatctgataatagacacagcatattactctattaactgcatatacagtaaaaacacagtatagaagattttaagataatctgtgtctatttttgtatcagtgacatgctgtttgggttactatagccttgtagtatagtttggagtcaggtaatgtgatggctttgttctttttgcttatgattgctttggctatttgtgctttttttgtcccatattaattttagaattgtttttttcaaattctgtaaaaatgatgctggtaatttgataggaattacattgtatctgtatattgctttgggtagtaattttaattatattgattgttccaatcagtgagcatgaaacatttttttatttgttgtatcatctatgattcctttcatcagttctttgtagttctccttgtagacatctttcatctctttggttaaatgtattttctaagtattttattatttgtatgtgtggatatcataaatggaattgagttcttgatttttttcttagcttggttgttattggtgtatagaaatgctactaatttttgtatgttgattttgtatcctgaaagtttactgaagtcatttatcaagtctaggcatctttcagaagactgtttagggttttctagatataagatcatgtcatcagtgaatagagataattttagtttctcttttttaatttggatgccttttacttctttctcttgcttgattgctctgcctaggacttctggcactatgttgaatagaagtggtgagagtggacatccttgtcttgttcctgttcttagagggaatgctttcaaattttcctcattgggtatgttgtcatggatgacccttatttgtcatagtttttttttattattttgaggtatgttcctttgatgcctagtttgttgagggtttctatcataaaaggatgttgggttttattgaatgctttttctgcatctattgagatgatcacatggtctttgtttttaattctgtttacatggtgaatcacatttattgatttgcatattttgaacgtagaccaatggaacaaaatagagaacccagaaataaaaccatatacctacaaccaactgatctttgacaaagtcaacaaaaatacacaatgaggaaaggacatccaattcaataaatggtgctggaaaaactggatagccatatacagaagaataaaactgaatgcatatctctcaccatattcaaaaattaagtccagataaaataaagacttacatggaagacctgaaactacaaaaatcctggaagaaaaactaggaaaaactcttctagacattgaactaggcaaaaaaatttatgacaagatctcaaaagcaaatgcaacagaagcaaaaatagacaagcagtacttaattaaactaaatagcttctatacggcaaaagaaataatcaacagcgtaaatagacaacctacaggatgagagaaaatgttttcaaactatcaaccaacaaaggactaatatcctgaatctataaaaaaactcagacaactcaacaagaaaaaaacaaccccattaaaaaatgggcaagggacatgaacagatatttctcataagaagacatacaagcaaccagcaaacatgtgagaaaatgctcaacatcactaatcatcagagaaatgtacatcaaaaccacaatgagataccttctcacatcagtaaaaatggctattattaaaaagtcaaaacacaaacagatgttggcaagaatataggaaaaaaaagaatgcttatacactcttggtgggaatgtaaattagtacatctatggaaaacaatatggagatttctcaagggattacaaatagtactactattcgacccagcaacaccactgctacccaaaggactacaaatagagctaccattcaacccagcaacagcactactacccaaaggaaacaaaattgttatgtcagaaagacacctgctcttgtgtatttatcacagcactatttacaatagtaaagtcatgaaatcaacctaagtgtccatcaatgtattattgtataaagaaaatgtggtatatatacaccgtggactactacacagccataaaaaagaataaaaccatatcttttgcagcaacatggatttagcttgaggccattatcctaagtggaatcactcagaaacagaaaataacgtactgcatggtctcacttataactgggagctaaacaatgggcactcatgggcatatagagggaaataatagacagtggagattccaaaagggggaatgatgggagggttgaaaaattacctattcagtacaatgttcaccattcgggtgatgggtacactagaagcccagacctcaccattatgcaatatatccatataacaaacctgcacacaaatgacctgcatcgtagtaacagtaataataaatatcaaaattatatgcttgtctagggcacttacaatgaatggggcttgcaggactggaaggtgctctgtgtaattcagcaagtgagtaagaggtcagtgaatgtaaaagcctaggacaatattatacactgctgtagactttataaacactatatacttaggctacagtaaatttgtttaacaataatttcattttctcaagaataagttaaccttaccttactgtagctttttttactttataaacttttaatttttttaactttttgtctctttcataatagcttgaaacacaaacacattgtatagctatacaaaacaattttcttttttatatccttatttatatccttttttatatccttattcttttttaatttttttttctattatttaaacttctgtactaaaaactaagacacaaacacacatattagcctaggcctacacagagtcaggatcatcagtattgatgtcttccacctgcacatcttgtcccactggaaggtcttcaggggcaataacatgcatcagctgtcatcttctatgatagcaatgtctttttctggaatacctcctgaaggacctacctgaggctgttttacagttcagttctttataagtagaaggaatatactctaaaataactattaaaagtatagtatggtaaacacacaaacaggtattaccgtttattactatcatcaagtactatgaactgcacataattgtatgtactatacttttatatgattagcagtgcagtaggtttgtttacaccaacaacaccacaaacatgtgagtaatgcatttgtgctacgattttacaatggctataatgtcactaggtgatagcaatttttcagctccattataatattatgggagcactgtcataaattgttgatggaaataccattatatggtgcgtgactgtataataaaacctgttccagtttgaaccattggccagagacaccaacagacacaatgtaatcaagatgtagaccccaatgtcagccttctagacacaaatgaaacaacacccaacttagctcaagaacactttctaaaagcaggaggctccagttccccaatctgtgggaacaaggagaaccacagtaagtgaagaggaaaatcattatctctgaacttgtcagaagaaaaatcccatcaaggaatgcttttgagaacttgaattctagggaagcccactggaggccacagccactacagaaatatagaggccacagcttcctgacatgcggtgaggccacatctccactcacttcctgtcagtaggtgtcacttgaacaaattttctcatgtcctggccagtcacctggagcctggaggcatgtcttactttgcatacacctctgtcaaaatgcgtatcagacaattatgttataaattgaatgtcttaggtgttacagagtaggtgttgtggaatgaatatttgtgtatcctccaaagcgcactctctctttctctcacacacacacacatacataccccaaggaaaggccatgtgatatctcgattttaaacttccagcctccagaactgtgagataacaaatttctcttcgttaagccactcagtgagtggtatattgttatggcagcccaagtagactaatacattaggttattctgctactgacccaccttactgagctagacctactttggtccccacatgtctccccagggacactgtacgaagcctggagctatgtcagtttttctgtactcaaaagtagtgccctcctatatttacctcttgtttgttttattggagttcctggcaggtatctcccttctctttgaactgtaaatagaaataatccttctttttgaagtaggattttctttctgaacaagcttataatttcctaccattgatcttcttgcatggcaatttcaattaaaaaatcatttgaataattatgttagaatacacagcaactatatttcttaggttagtgtagtttgcaaacaaaaggcatatatgttttcctagtaaccgcaatgtgtgtgtgtgtgtgtgtgtgtgtgtgtgtgtgtgtgtgttttaatttccctacaaatcactgctaacagccaaggaaagcgaggctatattctggaaggcctgggagatatagtcccctgtatgtgtatgaaatctgtttggaatctcatgtactatatttaaaattcatttgttactttctattatgtaatatattctcatttgtttcaacatacaaaaaatactttaaatcgattatttaaatgtatgtcatgttcatcccagagcttaatgtcacccttcatacattcatacactactacttggcttattcttcttgaggagagagaaatgtattgccagtattctcaataggtacactttcaaggctgagacagcagggctcatgaagaactggaacaatataaaccattgccgagactgcaacagcaaccatgatgatctcaaggaggcgacagatctaatggtaatgggaaaacacacccttgaggaatcagtgagcccctgcagctccctgtcatctctgtgcctcccacattccattaagagaatatagaaggaatgcatttttcatctgaattaaggtgttttgctttctgtttattgtttctttattttccaaaaatatgtttttcaataaaatctggcagtgattaaaaagaaaaaaagcaacataagattgtatttttatttggtggaaagcagcaattcattttaggtaacatgccaccacataacaggaatagagaaggtaagaaaggtaaatatacatacagaagtaagtcatgggcaaacctaaacaactaagaaaaaattagcaatgaaattaaaaggagaaaaatgcccagggaggcagaaatagattttcctgctctcctacgtctaaagagcacaatgagatacaaaacacaaatgccagtagatggcagaagctatttacctaaatcaggattgaggctatgaggcatagcttagacactcagtccagatcctaggcatttgaaactccaagttgcagaatcaattttgatcttaaaaaccaaacttcttcaaaattcccttctgtaaaagtgaggtttgctactattcaaagttttatttgcttcttaaagaatagccagaatgttcctaccactgtgttgataagcaaaggtaacattgcctctatcaggggctttttctcttttatttaagtctctgccttttatgtcaagggattcttttaatgtctaatgatcctgggatgctcattcatacttagtaggatacaaatctgagattcaagcaaagaaaaatggctccagttcctgtttttaaatacttcttcacttcactctcaactaagcctgatagcccagaatttcatgttatttattcaatatcttcagaaaaatagtcttttttccacaaaagtggttggaaaggagtggacacctgactattccaggtcaaatgggaaatctgagagtataactgcaatttattcaattttactttgcattttctctataaagtctcctacccctaccctctctctgattttctgaggtaccaggtatcctactcactaagacttctggtgcacctgaatttttgttggcatttgcttctgtgggaccttagaatttgcctttcttcagttcatttaagtcagttaccacttgttcattcacctgcattttccaaaacatctcacatgctgttatcctttgcctgttctatgtgtcctttggggttcataacttttaaaaacatttttactctcatttcaccaggtactcagaaaggaatagagaagtatgtttccaattcaccatacttaattatcagtctagccttcactgatatttcagagcaattataaggtgcccaggggcagagtttccatctgtcttgttcatgtctccatatttctctaatatatagtgaatactcattaagtgtgttcatcaagtgaaacggagaaatagaagaaactgaaaaagtggcatgaaaggacaaaaatttagcatttcaccatatgggggcagtgtctctattcatagctaaccttcaaggttagctcaaaaccctgggaaaacatctggtaagagatccgattggctgatatctggaacagagatttaaatttcgtggtagtgtttttagtgtcactctaagcccaagagagtttcttgaagcaaaaaaaaaaaaaaaaaaaaaacccattcaggaaataattctttgctgataaggatgctccttgaacatttattaataatcttgtggatgcagctgacatgtgagtcttgagagtttctgactcttccatagcgaattctaaagggaaggaaattctgtgagggcaggaggtgaggctttatcagagactatgaaaagaggaaaacagaaggaaaaaagctagagaaggagggaggaaaggaaagacacagatgcaaggctgggaagtttggtgatatagtgtccaacacagctctgaaaaaggtgatctaaagataaccttaaccaccttcttttctctttctaaacaggggtcagtggtcaacagctgaatcagagtcctcaatctatgtttacccaggaaggagaagatgtctccatgaactgcacttcttcaagcatatttaacacctgactatggtacaagcaggaccctggggaaggtcctgtcctcttgatagccttatataaggctggtgaattgacctcaaatggaagactgactgctcagtttggtataaccagaaaggacagcttcctgaatatctcagcatccatacctagtgatgtaggcatctacttctgtgctgggcagcacagtgctccccaaacacctgcagcctgtactcaaacttgcagctggaactctagtctctatgctgccttcagctcttagtcctcttggcatgaaatgtgattatgcatgccacctttgccactgccattctgtcaccacaaactctcctttatccaaggatttgtcctccaaagattgtgctctttgcttgatgaacttgcccctctcaattcatttttagtgtatgtaatagattttcttagttatttctgccacgatatgaggagaattgatcaacacacagttacagtagaagattttaataagtatctcttttaaaatggatgatatcaataaagtaaaaatgagagtccagaaataaatccataaatctatagccaatttattccaacaagatcattcaatgggaaaagaatagtcttttcgacaagtggtgctgggaccactggatagccacagttggatctctacttcacatatgtacaaaagttaactcaaatggattaaagacctaaatgtaagatctagaagtacaaacacttagatgaaaacatagttgtaaatcttggccaccttggactatgcaacaatctcttatatacaacatcaaaaaaagcaactgaaggaaaaatagataaattgggcattatcagaatttaaatctttgtgcatcaaaattcgcaaaatattccacaaaggaaaatgaaaagataacccacataatagaagaatatatttgcaagtcatgtttatctgataaggatctaatatcaagaatatatattttaaactcttacaatttaacactaagacaaatgccaattttaaaacggtcaaatgatttaaaccatcattgctccaaagaagacacacaaatggccaaaaagcatgaaaaaaaagatgctcaacattattattcattgggaaaatgcaaattaaaccacaatgagctgccacatcacacccactaggatgttcataatttttcaaaaaggaagaataagaaagagaaatgtaaaattctaagtgttggtaaggacgtggggaaattggaatcctcatccaccactggtaggaatgtaaaatagtacagacacattagaaaatagtttggcaatttctcaaatgactaaacacagagttaccatttgacccagcaataatagtcctaaatatctacttaagaggtcgaacatgtgatttatttcattggccagaaccacatcatatggccagtactaattgcaagggaggtagagaaagggagcatttaatttgtctagcctctaaaaaagacatgagcatgaaagatgtcaattgcagataaaagtgttggtttaactatccaaaaacatctgccacatcatactaggtcctcattccccagaagagactctgatgatacatcttgatattcttattactgttattaccctaacagcatgtgccaaaggaagctgaagtctgttaagagctctacagagctcttcaaatgtagtattgtttttgctccaaaaaatatactgtaggttttcttccttgcaactgtcctgtgggaaatcaatatctctcaagaggcatcagctgatgtttcagaggaatgatggtccactgcccctgatactgatatgcgcagttccaggcagttcttaaagctagtcgctttaacgcctcacagagatcatcatgttcttaaacatcgatacggaattcacttccatctccctgagaagcagtcccctgaagacccagcacaatatttccgtgggtcccacatgtgcatatgacataaccctcaaaatcctagggatgttttaattgaggtaatacttttacagctatttataggatctctagcacaattcttttctcaggaacttaaaaaatgggtattagctaaccatgagtaaccatgtttccttctcccttccccattcccattcagctgtatgtaggcaaatctaccatcccaactttctcgatgttgaagctatgatttattttatagcaggctttctattttattttatttttaaacttttattttaggttcaggaatacatatgcaagtttgttatgtaggtaacctgcatgccacgggggtttggtgtatggattatttcatcacccaggtaataagcatagtacctgacatgtttttcaatactcaccttcctcccacccttcatcctcaagaaagcctgggtgtctgttgttcccttcttcgtgtccatgtgtactcaatgtttagctcccgcatagaagtgagaacatgtgatatttggttttctttcccgtgttaatttgtttagaataatggccttcagctccatccatgttgctgcaaaggatgtgatctcattctttcttatggctgtgtagcattccatggtgtatatgtatcacattttctttatccagtctaccattgttgggcatttaggttgactccatgtcttcgttagtgtgaatagtgctgtgatgaacataggtgtgcatatgtctttatggtagaaaaatttatattcctttaggtatatacccaacaatgagattgctgggtcaaataataattctatagaaggctttttaaagtgtgggctagtattgaaggtaaagattgccttattcagttctgtatgctcctctgttcctggcacaaagaagacagtcaattaaaaatgtttacatgagaggccgggcacagtggctcatgcctgtaatcccagcactttgggaggccgaggcgggcagatcacaaggtcaggagttcaagaccatcctggccaacatggtgaaaccccgtctctactaaaaatataaaaaaaaaattagctgggcgtgatgatgcgcacctatagtcccagctacttgggagactgaggcaggagaatcacttgaatccaggaggcagaggttgcagtgagccgagatcacaccactgcactccagcctggtgacagagcaagactctgtctcaaaaaaaaaaaaaagttacatcaattaaggggcaagatgctaattaattctcatatctgtgcctctgtgccacccagaaatgcagaaggaagcttataaacaaaaaacagtgggttaaattatctgaccttcatggggacagtacaaactatattcataagcagtaatagaacatggcattatttactttattgtggtgttgtcacatcatcagtctcttacttcatgtttctgggttttgtttcttgcttaagatctagagaattaggccactttatcattgtcacaaaaaaagtagtcttggaaaccaagcgatccatcacttcctctcaactgggcaattcagcttttctggaatgcaaatatgtttgtcttcaccttgagatttgaactttctaattagtaattctttttcttagtgatcataaagatcaagcaagaaagtactagtcttcctagacttgaacactacctacatagattatatgtattttactaaaaatagacattcctagacgatgacaagaaaactatgtaataacatttatggaatggaatgcaaccaaagctatactccaagtatactagcgaaggccaaactattctaacaaatatatgccaaacgttcagaggcttaatgaacaaagtttgtctttcttgtgaaaatctggagcagatattccaggtcagcagatgactctgccttacatgatctttgaggaactgaggttattctcatttggggactctgctatttctcagagacttaccatcatatgcagggtcatggcctggctatgccaggtttcacttagcaaggagatgaacgagtgggtatggagcaggcatgaccattcccttaagaatcatggacaagaaataatagaattactgactcctaagattatggacagctttgggtagcctgtccttcaatggtaagacaattttagaagtatctaccatctttcataaaacatgtggacactagttttcagctattctgcaccagctcacaagatggcggtgttctattttgaatgacttccatgggtgattgagtgggagggatttgaatttaaatagaaccaaatgacactttttttaatggttggctgaattgccaaattgctatttccctttttctgagtgtgtgtctgtgtccgtgtgtgtgcatgtgtgtgtgcacgcacgcgcacacaggcagacgctaggggtagagtgtgatggttcaaaaagaaaaggaaacgcttaaaggtagtgaatcacgttttgcccaggaaaacacacttgataactgaaggatgatgaagtgtccacaggctttactagctatcttttggcttctactgagctgtaagtagggttactacaaagggtcaggggcaaccaggaaacctgaggattgatcctcagaacactaaaagggtaaagtagacttcgttctgacttattgtctgggagccctgtggttccaacggtgaataattatcacatttttctacacaggggtgagcagtgaagacaaggtggtacaaagccctctatctctggttgtccacgagggagacaccgtaactctcaattgcagttatgaagtgactaactttcgaagcctactatggtacaagcaggaaaagaaagctcccacatttctatttatgctaacttcaagtggaattgaaaagaagtcaggaagactaagtagcatattagataagaaagaacttttcagcatcctgaacatcacagccacccagaccggagactcggccatctacctctgtgctgtggaggcacagtgctccctagtcacctgcagcctgtactcaaattctacagctgaggctctgcaactgtaagatggggaacttgctacattgagcaagccctcaaaaataaactatacggaaaagcagttattggtcaaaatccttgtgcctatgttgacaattacttttgcagtttactgaatcctaactcagagtcatatcgctgcattcactactttctctgtgagttttctatgggattcagcatagctaatatttctagagggtcactcaggatactaactccattgccacaccattatgctctgtggtagaaagcaagcccttttatcaggattgtacaggcaactgatatgtgcactacacattagggaatctacctaacagctatggatgttttagcttctttcccaggacaggcacatttataggtaaagttctgcctataacatttttttctggacctactagcaaagaacaaagggtaggaacaagcaggtatcattacctgattaaaacaaaaggttttcattctcagttgcattattcttacttactatcttcattttaggattgttgcctatgctaggtacttcattaaagtggtgatagaatttttcaagatattacacattaatttgtgtacttagaaccttaagcagcctacgaaaagaaaggagttagttgaagtaagttatgtgaagctaacataaacttagcctacttatgttgtgatacactctttcaatgaattatgtaatcatatgtatggtatttacaaagagcttgcaatggaagctaccatttattgaaagcaagtattatgtaccttgtattttgcaaatatcatctcattgaattctcaaaatcactttgataaatcatcaatattactttctgttaacatattaggaaatgcagactcagaaagattaagcccccttccccacctcctaccccagacaaataactataacagaatctgaaatcaggtctatgactccaaactatactttgtctattacatgccctgatgttaaacatcactgaggagaaaatttacccacagtgtgaccacaattatgtgtaaaaaatgtacacaaaatacgaaaataatgtgttcaacatgtaaataaaataacatttgcaataatatgtgaataaaataactccaaaagtttgcaacagtattagttatctttgaatactgaacttaatactgttcattgttttactcctttataatattctttatttttcagattatctactatgaactcaatactattattatttcagaaagaaaaatatacattttaaaataccaaaatccaagtaggctgaactgcattatatgataattatctgacactcacagtagcttaattacaatgaggaatagacatgactatacatagccaaatgatacagcattaaaacaagatttttgattgctagctcttcaaatcactgtagactagtgctctcttcaattgggaatgttttaaaattacaagaagacctatttctcctgagaatttatttgaatgactgtcctatgggtagaatgctttaatatcccatctctgtgtaggagaggacaggcagtaaaggccacccgtgcttgtgagttcattagacaattcattgcaaattgggcatggtttaggtttcactgtctgggaaatggggagatagcctgagaaaagggcaggtaaacattcaaagaggaggggaagaaacagtataaaaattaatagaatgtatcctgccatttttagcctgcacagtcttctgtccattttcctttctcctttctatctgcatcaaaacccagaaatcacacagtggatataagaggaaactctgacagtcatttatttaagactgaaaaatagagcgggaaaccctatgcaagatgcccagtgtgtctggctctgcggtgtgaagagtttatgatttagaagccagagatttagctgtctttgatgggaatgtgcagttggaagggggaagtttcttttttcactctttattgtttcctatcctaatgagaaccaaacaatttacatctcaaaagatcaacctgtcaccaaaataacatgtattttaatgctaagactaaatatccatttgttataaaagaaaaaacaaattaaaaaaaatttataacctcaacctacagacattaccactattaactatttagcattttgctttccatttcacctgtatcaatgaacatgaaaaaataagtctgtagagatgtggggaattcaacttatttcaaacaaagagtgtttctcaaagtcactgcaaaaataggtgtttctgttccttaaaaaaatctacatggttaagatcctcccacttttgacctgtgagttgtgataaaaagcttccagaaaactcatctcagtgacttgattatgaaatgctaccagtttgaagcagtcactgaaaaacataaggtcataaatcaggaatccagaagaaacaatgaatagcaactttatcttcacttcacttctaacactggctctccaaggtaacagccctatcctgtacccagagtggcccttctggagaaggtggctggtttgacctatgactgttgagtgttttacattacagggtctgggagagcagactggatcaagccccaggagacagaagtatctggaacagaagggaagactgtgaacctactttgtaactatggtacatcatcggggagctatcttgatctctgctggttttgacagtatccgagccaggcatcagaatacattctctacagagggtggggatattctggaaaaggagatgccagttttgccataggaaagtttattcaaagagtacagcaaatgcaataaatgtgtacattagaaatctggttcctgcagacactgccttatattactgtgtgctgagatgcacaaaaagaacactttctaggggtgtcatacaaaaacaccagcgcacaggaggaaggagagcatttgttataaccacactgatttttttttttttttttttttgcaaaggcgtcattgtaagtggaagacactggatcaggagaattctgctttaataatagctatatatagtaatttgtaggcaaatagcttgagcttttagagtttccatttcctgaaattagatagcaattctaatttgtaagcttttatgagacatggttttaacacttggattaagtgcctagcatgtcctacatgctcagcaaatggcaaatatcttttcttgctctccctctctgtctaactactttgacctcaaaggacccttctttcactatctgagaatcttctatatactcctactggtaaaataataacaacaataacaataataataataataaccctaaaaacatacatgcaagacctagatagagaaggcttctttgcccagggatcaatggtcattgtgccaggattttaaaagtgtatgctcagcaaatccaacaatcagaggacaaaaggaccccgagacactagctcctgagttcatagaccagggcagttgggcatttatcgtgatctgaacaagaacaggagagagttcctcacaagactaaagagaagagaaagacatttagcattaggtgggtggtgggagagaagagagaaattcttgggaagactacagccatgttctggtgtcagatctgacctccctagatggagaagagaggccaagtgaggcagtgggtcctcagcccacctggtagaggaagagggcacctgccacttcctgcactggttcaaactacactcctaacagaatcctatcatttaatctggatgtgagcaaagcctagcatctttgtttggactggtgatagatgaaaggtaaaagaggaaggaagatttaatttagagccttattcaatagtctgcagcagcactagcaccttactgcttgcaggccggaaacctcaaggtctagcagttcacagtgaagcctgcaccacactggctgctgagtaactgccccagtcactaggagggcttggaaatcagacagcaaatgacaccttaaaaaatatgtataaggccattcttgcactgttataaagaaatacctgagactgtgtaatttataaagaaaagaggtttaattggctcatggttctgcaggttttacaggaagcatggtgctggcatctggttggcttctcagaaggccccaggaagcttataatcatggtggaaggcaaagggggagcaggcatgtcacatggccagagcaggagcaaatgagagagagtgagggggaagatgcaacacactttatttaaaccagatcttgtgagaactcactcactaaagcaaagacagcaccaagccataagggatcccacctccatgatacaaacacctccccccaggccccacctctagcactgaggaatacaattcaacatgatttggatggggacaaatatccaaactatatcattccactcttgatccctcctaagtctcatctccttctcacattgcaaaacacaatcataccttcccaatagtcctccaaagttttaacaaattccagaattaactcaaaagtcccaagtctcatctgagacaagtcaagcttttccaccaatgagtctgtaaagtcaaaaacaagttatttactcccaagatataatgtgagtatacacattgggtcaacattcccatttcgaaagggagaaattggccaaaagaaggggccacaggtctcatacaagttcaaaacccagcaaggcagccattaaatcttaaagctccaagataatctccttagactccatgtctcacatccaggacacactggttcaagaggtgggctcccaaggcgttgggcaactccacctctgtggctttgcagggtgccacccccacagcttctctcataggttgttgagtgtctggcttttccagacacagggtgcaagctgccagtggatgtactattctgggatctggaagatggtgacccctttcccacagctctactaggcagtgcttcagtgaggattctgtgtggggcctccaactcctatttcccctccacactgccctagtagaggttatttgtgggggctctccccatgcagcagtcttctgccttggcacccaggctttctcatacatcctttgaatctaggtggaggctgccaagcctctttcactcttacattgtgtgtgcctgcaggcttaacaccacatggaagctgcccagagttatggcttgcaccctccaaagtggcagcctgagatgtacctgggcccctttgggtcatagccagagtggccaggatgtggggagcagtgtcttgaggctgtgcagggcagcagagtcctggacctggcccctgaaaccattctctcctcctaggcctcaaggcctgtgatgggaggggctgctgcaaacatctctgaaatgcctttgaagccttttccccattgtcttggctatctggctgtcttttagttatgcaaatatctctggcaagcagttgctttgaggcttgcttgaattcctttcctgaaaaatctttttctttctctcccacatggctaggctacaaattttccaaacttttacactctgctttttaaaatacaagttctagctttaagccatttctttgctactgcatctgagcataggttattagaagcagccaggtcacctcttgaatgcttcactgcttagaaattgcttccaccagatatactaaattatcactctgaagttcaaacttccacaaatccctagggcaggggcacaatgcagccaagtttgttgctaaggaatagcatgggtgacattcgctccaattgccaataagttcctcatttccatctgaaatttcatcagcctggccttcattgcccatatcactatcagcattttggtcacaatcatttaaccagtctctaagaggttccaaattttcgctcatcttcctgtcttctgagccctccaaatttctcagacctctgcctgttacctggttccaaagctgcttccacattttcaggtatctttatagtaatgccccacttctcagtaccaatttgctttattaggcctttcatgcaccactataaagaaatacctgaaacttggtaatttatttaaaaaaaaggtttaattggcttatggctcttcaggctttacaggaagcatggtgctggcatctggggaggcctaaggaagctttcaatcatgacagaaggcaaaaggggagcaggcatgtcacatggccagaacagacacaagacagagagagtgagggggaggagccacacacttttaaatgactagatcttgtgagaactcactcactattgcaaagacagcaccaagtcatgagggatctgccctcatgatccacatatttccccccaggccccacctccaccattggggattataattcaacataagatgtgggttgggacaaatatgcaaataatatcacaataatttcttttataaaaaagtgaaaaatacttttattagagaataattttcaaagatctgtttaaaactaacttttaaaaacaatgaactatgggaaacattcactaatgcataaaataaaatatgtaatctttttcattttcagtttgtgcaaagttattttcacaccctgctggtagcaacacaatatattggtacaatcttttacacagtgaattacttggaaagggattttgagattcattaaacagttcatgcctttgaactgtttgaaactgaatgaacacctttgatccatttctcagaatttatattaaagattgattttaagtagaaaaaaccctctaggcaagaaaatagtaaaaatttctcaaccagttagaggaatttggatggcaacttgactgaatactttacaactatttaatgagttaataatactaaaaacatagtaatgctcttgacatacagttagagaaaacatagagttcctataataaccatatgctcacactaatatcgaatgaatgaagcacatagataaaaactggaagttttgatgcaaaactgaaagtatgaaattatttagtgtatgtacttgcaatattttaatttttatttttttcatggaataactgtgaacttgtgcctacaataaataacattttaaaaattctcttgactccaaatgttgtagctagtggaaaaacaaacaaacaaggatctcaaccccagctctgtgcctcagctgtttctcctttcttcaactctggggcatcaattttctggttcccttcccttaactaagtcctcttcttcattattccccaagacctgctgacagaaactctgctgaaatattatttgtgtctcaaacctatctttgatatgggcaaataaggaaaaaactattttcagttcttttctattttctctgcagtagactcagtagctagaagattgagctgattgtaccaaaaattaagaattcttcattgacatcacatgggaaaaccatctctggttttccaagaaggaagattaggtaaggctatataccttgtcattttttttaagttggaacattaaagataaagcttaagtcctctctgctcatgttttcatctgttctcttttcccagagctaaatgttgctctgggtttgtgaaaggaaattaaatcttgggaccccaaactcattgagccaaagggaaaagttaagctgcgaactgggccatgcaaacctgccttgccctttcagttcctacataagatggctacaagatgaaaagctacatgactccaccatattttgcccacaaggaaattcctagtgagctgcaagatctttaccctatagtgtctctgttaaaatttcaccttggaaggccgggtgcggtggctcatgcctgtaatcccagcactttgggaggccgaggtgggtggatcacgaggtcaggagactgagaccatcctggctaacgtggtgaaaccccatctctactggaaatacaaaaaattagccaggcatgtggcgggcgcctgtagtcccagctactcgggggctgaggcaggagaatggtgtgaacctgggaggcggagcttgcagtgagccaagatcgtgccactgcactccagcctgggcaacagagtgagactctatctcaaaaaaaacaaaaaacaaaaaaaaatttcgccttggcaatgtaaactgatagcttattatctttacaggtgcagtcaacccctgtccaccagacataaatacacatctgattgttcccctgccccattttgcctatgttatcttgtgtaaaaatgcaaattccctgcatttttcctctgccccatttatctatgtcatcttatacaaaaaaaaaaaagcagattcactaagccagacaaaggcatgaataactatttttccctacccttctcttacctaaaaattgtatacttctcaatatcccaccctttcccctttaaatctggagccctcaaaatcatcttcggagaaagtcatagacctgtctcctgggcacacatccttaactttggcaaacaaacctaaaatgattgagacttgtctcaccatttttctcaattgacacgtttataatttacattttaaattctttatctttattaatacgcacatataaatgtacatactcatgggaaatataaactatgattttatggcattttttaactaaatgttacatatgatatgtttttctccacaatttcctttcattttactcaacaaaatagacttgaagactagccaggttgatagagatcatctcatttccttttaattcatgtaaagtaaatcattctatcaatatgctatatttaataatactgatagtaataatattatttctccacaaagtagacaactaaggttcagaaagattaatttgccaaggtcacataattagtaagtggcagaatgaaagacaaatcaaatcttctgactttagaaagttcttctgtctttctcatttccaacatgtttagtggcaagagaaaggttttcttcacagaaacctaatatcccaagcaaatttgtatgtaggatttctcttgaaaattacctctcacttggctctgttcttatggctattaggcaataaatactaataataaaaataaaaataacaaaaacccctctctcccatattttggaaatttttcaatgcaacacaatggtcaatgttgttcattttttccctcatttctttgtctccaaccaaagaagcatatctctattttaattactcaacagtggggaatcaaactgattgggatataaacctaggcatttgagctggcaatggctaccctctttgggtcccctccctttgtatgggtgctctgttttcactctatttcactctattaaatcttgcaactgcactcttctggtccatgcttgttatggcttgagctgagctttcgctcaccatccaccactgctgtttgccaccatcgcagacctgctgctgacttccatccctccagatctggcagggtgtctgctgtgctcctgatccagcaaggcgcccattgccactcccaattgggctaaaggcttgccattgttcctgcacagctaagtgtctgggttcatcctaatcgagctgaagagtagtcactgggttccacagttctcttccatgacccatggcttctaatagagctataacactcaccgcatggcccaagattccattccttggaatctgtgagaccaagaaccccaggtcagagaacacgaggcttgccaccatcttggaagtggcctgccgccactttggaagtggcccaccacaatcttgggagctctagaagcaaggacccccggtaacattttggtgaccatgaagggacctccaaagtagtggtaatattggaccactttcactcactattctgtcctatccttccttagaattggaggaaaatactgggcacctgtctgccagttaaaaatggttagcgtggccaccggacttaagattcaggtgtgaggctatctggggaagagctttctaacaacccccaacccttctgggttggggacgttggtctgcctggagccagctcccactttcaactttcttggggaagtggaggactgactagaggcagaaagctctcatccagaactcccagcagtagccggttgagaccatggcgcagccagaagtctctagtcaacagtcgcccatacctcctgggtcccgaccacaactttcttgaaagtgtagccccaaaattctccttacctctgaatctacttcctctgatccctgcctcctaggtactaatggttcagactttcatttcctctagcaagttgtatctccaaagggatctaaggaagctctacactgtgtccttaggcacttaggctataacccagggagtcttatccctggtgtccctcccaatttaggtatacggctctcaacatgggctgttatgtgggacacattccccaccacccttgtcagggccccaagtttgtaatggctaagagagagagacagagagaagacagagagagagagagatggagagagagagagacaaagatggagagagagacaaagagggagtcaaagagaaaaagatagaaatagaaaaagaaaagtgtgccctgttcctttaaaagccagggtaaatttaaaacctgtaattgataattgaaggtcttgtccatgaccctataacactccaatacttttttatttacactttgttgtcagtgtaaataagggcttagcccgaaagcactgaggccactgacaacctgtagctttcctatcaaaaatccttaacccagtaacccacggatgggccaaatgcattcagtcagtaccggcaactgctttgctaaaagcagaaaagtaacttttagaggaaacctcattgtgagcacacctcaccagttcagaattattctaagtcaaaaaagcaaaaaggtagcttactaactcaaaaatcttaaagtatggggctattctgttagaaaagggtaatgtaactccaacctctgataattcccttaacctagcagatttcctaacaggggatttaaatcttaattaccatacaaaggtccgaccagacctaggaagaactcccttcaggacaggatgatagatggttcctcccaagtgactgaggaaaaaaccacaatgggtattcagtaattgataaggagactcttgcggaagcagagttagaaaaattgcccaatagttggtctcctcaaatgtgcgagctgtttgcactcagccaagccttaaagtaattacagaatcaaaagactatctcaatcctgactcaaaaggttacctacaccctctctgaaatgaatttgcataagaactgttgtttatgggaatgcatcttgatggggcagctgggttgttatgaaatactcaggaaactagcccagatctaggactcacccctgagagcaaaggcaatgttgggcatgctggtaaaggaccgctagaatccagcagccaggaccactttctttgtggtcaagaaaggtgggaaaacaggtgcaggactgctacactggtaagcataactaatccgataagcagaggtccatgggtggttacgcaccctggaaaggaataagcattaggactatagaggacactctaggactaatgctcatcggaaaatgactaggggtactggcatccctatgttcttttttcagatgggaaatgttccccccaaggcagaaatgcccctaagatgtattctggagaaatgggaccaatctgaccatcagacactaagaaagaaatgacttatattcttctgcagtaccacctggccacgatatcttcttcaaggggcagaaacctggcctcctgagggaagtataaattataacaccatcttacagctagacctcttttgtagaaaagaaggcaaatggagtgaagtgccatatgtacaaactttcttttcattaagagataactcccaattatgtaaaaagtgtgatttatgccctacaggaagccctcagagtctacctccctaccccagcaagaccccaactccttctccaactaataaggaccccccttcaacccaaatggtccaaaaggagatagacaaaggggtaaacaatgaaccaaagagtgccaatattacacgattatactcgctccaagcagtgggaggagaatttggcccagccagcgtgcatgtacctttttctctctcagatttaaagcaaattaaaatagacctaggtaaattctcagataaccctgatggctatattgatgttttactagggttaggacaatcctttgatctgacatggagagatataatgttactgctaaatcagacactaaccccaaatgaaaaaagtgctgccataacagcagcctgagagtttggcgaactctggtatctcagtcaggtcaatgataggatgacaacagatgaaagagaatgattccccacaggccagcaggcagttcccagtgtagaccctcattaggacacagaatcagaacttggagattggtgccacagacatttgctaacttgcgtgctagaaggactaaggaaaactaggaagaagcccatgaattattcaatgatgtcccctataacacagggaaaggaagaaaatcctactgcctttctggagagactaagggaaggattgaggaagcatacctccctgtcacctgactctattaaaggccaactaatcttaaaggataagtttatcactcagtcagctgcagacattaagaaaaaacttcaaaagtatgccttaggcccagagcaaaacttagaaaccctactgaacttggcaacctcagttttttataatagagatcaggaagagcaggggaatgggacaaatgggataaaaaaaaaaaaaaggtgactgctttagtcgtggccctcaggcaaatggactttggaggctccagaaaagggaaaagctgagcaaattgaatgcctaacagggcttgcttctagtgtggtctacaaggacactttaaaaaagattgtccaagtagaaacaagctgcccccttgtccatgccccttatgtcaagggaatcactggaaggccaactgccccaggagatgaaggtcctctgagtcagaagccactaaccagataatccagcagcaggactgaggatgcccagggcaagcgccagcccatgccatcaccctcacagagccctgggtatgcttgaccattgagggccaggaggttcactgtctcttggacactggtgtggccttctcagtcttactctcctgtcctggacaactgtccttcagatctgtcactatccgaggggtcctaggacagccagtcactagatacttctcccagccactgagttgtgactggggaactttactcttttcacatgcttttctaattatgcgtgaaagccccactcccttgttagggagagacattctagcaaaagcatgggccattatacacctgaacatagcagaaggaacacccatttgttgtcccctgcttgagaaaggaattaatcctgaagtctaagcaacagaaggacaatatagacgagcaaagaatgcccatcctgttcaagttaaactaaaggattccgcctcctttccctaccaaaggcagtacccccttagacccaaggcccaacaaggactccaaaaaactgttaaggacctaaaagcccaaggcctagtaaaaccatgcagtagcccctgcagtactccaactgtaggagtacagaaacccaacggacagtggaggttagtgcaaaatctcaggattatcaatgagactgttgttcctctatacccagctgaacctaacccttatactctgctttcccaaataccagaggaagcagagtggtatatagtcctggaccttaaggatgccttcttctgcatccctgtacatcctgattcccaattcctgtttgcctttgaagatccttcaaactcaacgtctcaactcacctggactgttttacgccaagggttcagggatagcccccatctatttggccaggcattagcccaagatttgagccaattctcatacctggacactcttgtcctttggtatgtggatgatttacttttagccacctgttcagaaaccttgtgccatcaagccacccaagtgctcttaaatttcctcaccacctgtggctacaaggtttccaaaccaaaggctcagctctgctcacagcaggttaaatacttagggctaaaattatccaaaggcttgagggccctcagtgaggaacacatccagcctatactggcttatcctcttcccaaaaccctaaagcaactaagagggttccttggcataacaggtttctaccgaatgtggattcccaggtacagcaaaataggcagatcattatatacactaattaaagaaactcagaaagccaatacccatttagtaagatggacacctgaagcagaagcagctttccaggccctaaagagggccctaacccaagccccagtgttaagcttgccaaggggcaagacttttctttatatgtcacagaaaaaacaggaatagctctaggagccatcacacaagtctgagggactagcttgcaacccgtggcatacctgagtaaagaaattgatgtagtagcaaaggattggcttcattgtttacaggtagtggtggcagtagcagtcttagtgtctgaagtggttaaaatgatacagggaagagatcttactgtgtggacatctcatgatgtgaatgccatactcactgctaaaggagacttgtggctgtcagacaaccgtttacttaaatatcaggctctattacttgaagggccagtgctgcaactgcgcacttgtgtaactcttaacccagtcacatttcttccagacaatgaagaaaagatagaacataactgccaacaagtaattgctcaaacctatgccgctcgaggggactttttagaggttcccttgactgatccccacctcaacttgtatactgatggaagttcctttgtagaaaaaggacttcaaaaagtggggtatgcagtggtcagtgataatggaatacttgaaagtaatcccctcactccaggaactagtgctcagctggcagaactaatagccctcactcgggtactagaatcaggagaaggaaaaagggtaaatatatatacagactctaagtgtgcttacctagtcctccatgcccatgcagcaatatggagagaaagggaattcctaacttccgagggaacacctatcaaacatcaggaagccattaggaaattattattggctgtacagaaacctaaagaggtggcagttttacactgccggggtcatcagaaaggaaaggaaagggaaatacaagggagccaccaagttgatattgaagtcaaaagagccacaaggctggaccctccattagaaatgcttataggaggacccctagtatggggtaatcccctccgggaagccaagccccagtactcagcaggagaaatagaatagggaacttcatgaggacatacttccctcccctccagatggctagccaccaataaaggaaaaatacttttgcctgcagctaaccaatagaaattacttaaaacccttcatcaaaccttccacttaggcattgatagcacccatgagatggccaaattattatttactggaccaggccttttcaaaactatcaagcagatagtcagggcctgtaaagtctgccaaagaaataatcccctgcactgcaggccatacatttcaatccctgtatctttaacctccttcttaaatttgtctcttccagaatcaaagctgtaaaattacaaatagttcttcaaatggagccacagatgcagtccatgactaagatccaccacagacccctggaccagcctgctagcccacgctccaatgttaatgacatcgaaggcaccccctcctgaggaaatctcaactgcacaacccctactacgccccaattcagcagaaagcagttagagtggtcatcagccaacctccccaacagcacttgggttttcctgttgagaggcgggactgagagacaggactagctggatttcctagactgactaacaatccctaagcctagctgggaaggtgactgcttccacctttaaacacgggacttgcaacttagctcacacctgaccaatcaggtaggaaagagagctcactaaaatgctaattaggctaaaacaggaggtaaagaaacagccaatcatctatcacctgagaacacaatgggagggacaatgatcaggatataaacccaggtattcgagctggcaacggctaccctctttgggtcccctccctttgtatgggagctctgtttttactctatttcactctattaaatcttgcaactgcactcttctggtccatgtttgttacggctggagctgagctttcgctcaccatccaccactgctgtttgctgccgtcgcagacctgccgctgacttccatccctccagatccggcagggtgtctgctgtgctcctgatccagtgaggcacccgttgctactcccgatcgggctaaaggcttgccattgttcctgcatggctaagtgcctgggttcatcctaatcgagctgaacagtagtcactgggttccacagttctcttccatgacccatggcttctaatagagctataacactcaccacatggcccaagattccattccttggaatccgtgaggccaagaaccccaggtcagagaacacgaggcttaccaccatcttggaagtggcccaccgccattttggaagtggcttgccaccatcttaggagctctgggagcaaggaacccctggtaacaaaacctgatgtttgttctctactaaggaataaaacaggcatacatgtgagataactataaagagtcaggacatgatagaggtctgcacactatatcagaagccctgtttccagctctgtggctgcagcatcgcacaactccagtgctctgcctgaggctggctgtgcatgcagagctgagccctaggttttggcaggacaagacatgttttattcagggagatgagaaggcctgtcaacatgtactgccccacctgctgcggccaactgtggcctccatcttccccagtaggcagggatggactgagggaggaaagacacctggggcacatctgaaagatgctttgggccggggacaaaaaagaagtgatagaaaccaggctgtgctttttattgctgtcaggacaattttcttaagacatgggggtttcttttttttttctttttttttttttgagacggagtctcacactgtcgcccaggctgcagtgcagtggcgtgatctcagctaactgcaagctccacctcctgggttcacgccattctcctggcttagcctcctgagtagctgggactacaggcgcccaccaccatgcccggctaattttttgtattttttagtagagatggggtttcactgtgttagccaggatggtctcgatctcctgacctcatgatccgccaacctcagcctcccaaagtgctgggattacaggcatgagccaccgcgcccggacaggacatgggggtttctaaacaaggctcttcagtatcagctcattgtgagtcacagatcagatctgcccagttctcttttgctgttgacattgttgtttcctctgcaggattcagcagtactgaaagggttattcagtcccaacatgggatctttacacaagaaggggagcttgtgaaatgcaagtactttgcaaatagctcaacttattttctttcttgttttgggcagcattccagtgaggaaatatttcacctgatttctcagagtttaggagcatccaggaacgcaaggaataaaaaatgttctgtgaacctgcaaatagctgccaacactgtcattctcaccatttcagttatgagaccaaaagactcaggaaacagtttctgtgcactcaagacatctacagtaagaggaacaataaaagttgtagttaaaaaaaacaaaaaacaaaatactcagagcttgtaccccagactcatctgccacagggactgggagagatccacgggccctaaactgaaaaaatgtgagcctgtggacagcattcatgaagtatggacaggaaacaggtaactgttgcaagaaaaaccctctcaaactgcattcattgagcagtgctttcaatccacagtccttaaattgactttctccttcaaattttagcaggtaacaaaacagtactttattttaatctaattatttttcttttttctttaactttttatttgatatatttcaaaatataaaataatactgcttattgtaatagatgaagtaataaaaagttttataaagaaaaagttaattctcactcatctgctccctactgaagtaaataatattaataacctgataagtgtcctttcccactattctttctgcttatataaatataggcaaaaatccctcctagtggaacaaatctgcttggggttttttttgttttgttttggtttggttttctgagccggagtctcgctctgttgcccaggctggagcgcagtggcatgatctcggctcactgcaacctctgcctcctgggttcccaccattctcctgcctcagcctcccaagtagctgggactacaggtgcccgtcaccacgctcagctaattttttgtagttttaatagagacggggtttcaccttgttagccaggatggtcttgatctcctgacctcgtgatccgcccgccttggcctcccaaagtgctgggattacaggcgtgagccaccactcccggccacaaatctgttaataaatgtgtgaccaattggaatttttcctctgaatcgccttttacatctttgtccatttttcttttaggttatatatttctcacttaaaaatgcatgctagagatgtcaaaaattttttttatttctccagtctattgtttgtcttctgattttgtttatagcacgtagcatggtatcctttgcctctaaatatactctaaactgtatatagttaaatatgcctgtcttctttatatcttctgcatttctaccatacttaaaaatagtacaggtttatataaatattcccagattcttagacaacagttttatcattttgctttttacaataaaatctttcaaccatctggaaactgtttttatatatgaaatctattttccactattgaaatgtctttgtcatattttatgtttcttaaacataatcaaattatatacatccatattaagaactttaccagtatccaaacattacagaataatgtaagaatcacagtggaactgggtgctggtgaaaataatcactgaattctccagtgccagtttgaaaggagaaattattagccattccactggggtgagaaaggccaatgagtttgactgatgttaaccaaagagagattaaaggatggactaaaagtataaaggggtgacatcttggggaaatgcaagtcttgtgcagagagaggaagatgtttaacttatcctactcaactcctttcctatatgaccggaggtgcctagtccagcttccacccactccactaagttgaggaatagctatcatcacatgtctggaagataatcagcttctgaactggcagagcgtctctggttcttgtggcaaagacataaaatgtgggagaaagtagagaaaaagaaagtgtggtagcctgcattcccaccttttattgaggcaatttttcatgtactagtggttttaatgaatctgtataggtctgaaccaacttgaacctgaacctaccctgcctccaaacagctgtcacttaggggaaggctctagcacaggaggctgtggattgacccatgtgtgaactggaggaggaggaggaggttgagcttgagaacgatcaccactccaggaaatcacgcagatgaagggccctgtagccccctgaagaaaacactagcacaccgttgtgagaaagcacacatttggatttctgccaccaagagggaatccatggccaggaagagataagaaccaacaggaaggagaaggaacctctccatcagaaccctgagaaattcacataaggaaacagcatctgagcaaccaagaagacaaggcccctcagcccaggagaggctgaaaagagagtcctttatttctcccaccactctgcccaacagctgagggttgacatggggtgaagtctgaaagaatagcacatctacctgtcagtggagctcccagagtcttcctgctgggtgtgggtggagggtagagctttgactctaaaatactaattaagttcaaaatgaatacacacatagttggaacaaaactgctttagtaactaaaagagaaaggataacctgtttcccagtggaaaagagatgattgataagtgaaaaaaaaatgaaaacaatttcacactcacatttatctcatgacttgaaatgctctagtcagcacagtaatatctggatctctttgggtattttctattaaatgttccgcttattggcttaatccttcacttatatcatattgttttgtttagagtagtttagagtaagtttttatgtcataaaaaaactgatcttaatattccttttcaagaatgcagttgaaagttcctagatatttgttctctcttatgcatttcatcttgttcaaacaaatggcattctgactgtaactactttggaaagtttaacattttaggacattatatttttccacaaaagaaaaatccatctatttaggtcttattttaaaagtaaattttgcatgtttgtttgtttcttacataccttccactttctttttttttgagacaggatcttgctctgcagcctaggctggagtgcagtggtacaatcatggctcactgcagcacagacctcccaggctcaaatgatcctcccacttcagcctctaaagtagctgggattataggcatccaccatgcctgactaattttgttttttagagatggcgtctcactgtgttgcccaggctggtcttgaactcctggcctcaagcaattctcctgccttgaccttccaaagtgcagggattacaggtgtgagccactgcacctggccagatttctgcttttcttattaaatcaattgctaaatattgtatcatctgtgttgcattattactgaaatttttcttcatttagagaaatttattccatataaggaaaaattactaatttttaatatttgcttaatagccaacaatttttgttacttgttgatttttagcagtactatgaccaaagtggcacatgtacatgtttattttttaaattcctgaatagtacagaaaagtctgtattacaaatctggtttcttatttctctccaactttcaatccttgtccataaatatttacacttttaagtctggatcttctagcagtgagctccatatttctaaataatatgttttaactacttcttgcaacatacattttattcttttattttatttacttatttttttagatggagtctcacactgtcaccctggctggagtgcaatggcatgatctgggctcactgcaatctctgcctccggggttcaagcgattctcctgtctcagcctcccgagtagctgggattataggcatgtgccaccacatccagctaatttttgtacttttagtagagacggggtttctcctcgatggccaggtttgtctcgaactcctagccccaactgatccacccgccttggctgcccagagtgttgggattacaggcatgagccaacgtgcctggctgcaacatgaattataggtgttacctgttgactttcgttttgttttttaaatagacttaattttttaaagcaattttaggttcacggaaaaattaagcagaaagtagagagtttcccatatacttccaggcctcacatatccacaggctcccatgctatggacatcttccaccagagtgataacatttgttccactgatgaagctacattgacgtattattattacccacagtccatagattacattagggttctctagtggtgttgtacgttacatgggtctggacaaatatataatgacgtgtagccgccattacagtctcatacaggttgtttcactgccccaaaatcctctgtgctctgcccgttcactcctccctccccccagctcctgacaaccactgatcttgttactgtttccatggtgttgactattccaaaatgtcatatacttagagtcataacagtatatagcctttttagattggcgtctttcacttagcaataggcatttcagatttttccatgtgtttcatggcttgatacctcatgtcttttgagtgctaaataatattctgttgtctggatgtaccacagtttatttacctattgaaggacatcttggccacttccaagtttgggcaattatgaaggaagctgctataaattcatgcacattttgaactcatttgcttaaataagaaagagcataatttctggatcatatgcaaagaatatgtttagctttgtgagaaactgccagttttcttccaaaatggctgtaccattttgcattcccaccagcaaggaaggagaattcctgttgctccacaccctcactggcatttggtatcgtccgtgttttggatttttgccattctatctggtgtggagaggtcgctcattgttgtaatttgcaattccctagtgacatttgcatggagggtatcttttcatgtgcttatttgtcatttatgtacatttttaatacgtttcactttgggggtcatttagccttcacctggcaaaacaaacaaatgaaaatttacacataattctgtgaattaatttttaaaaacttcataaacctcacctttatccacttttattcttacttatatttacctagtcagacttttcagaactttttccaagttgtcagaacatatttaaaataataaaattaaaataggaggaatttttgcctgtcacctttgctcttctctcttttccctcatccactcccacaccttttcttctttagtttccttccccaaccattccaaacactcattatgcccaagcctctttggacacttcgatcaaaattttctcctctatatcatccggaggaaatgcaccgtttgctcagggacacttagctcacctgcttcccacgttttctctcggtctccacttgtgtctggactgagtgttgctgaccaccacagcatcaaagagcctgtgagaccactggatgcagtctgggggtcagtgacctcagaggaaataccttcagtgtcccacgggctctgcaggtcagtgcactcagagtgagcttcctcacactttgctggggaaagtgtccagtagcttcaataatctcatgaccaaaagactgaagagaggggagaagacatccgagttcacattttcaggcaatagtagctgacatttcctgaatgatccttgtgtgtcaggcaccttaggtccgttcatgacttaccacatgtttctgtatgacagcaccatggggaagcttctgtaattaattcctattggataggttgctgctgatggaagtggggtctccaaatcctctatcccagagtctgtgctgttctgcagactgaatatgctttctccccaccccttcctcaggctttggcaaaggagacctctgaaaaatggcacttagtatattattgacttttgttttttaattggcttttggactaatgaggtcagtataatgtgtgaaaccaaactagaaggcagtgctggtaagtttgttgagtctctgacaaatatttggattctgagcaattcaaacatccaggcaactttaaaaggtcttcttcctctgagactcatagtgacttatacaaataaaaataaaagattagtaataatagtagttcatcaaacactgcatttacttatattttctcaaatactattttcttttttttgaggcagagtcactctgttgcccaggctggattgcagtgatgcaatcttgactcactgcaacctctgcctcttgggttcaagcgattctcctgcctcaatctcctgagtagctgggattataggcatctgccaccaggcctggctaatttttgtatttttagtagagacagggtttcaccctgttgtccaggctggtcttgaactcctgtgatcacccacctcggcctcccaaagtgctcaagtgatcacccacctcggcctcccaaagtgctgggatttcaggtgtgagccaccatgcccagcttcgaatactattttctaccataccatttaaatgtcattcaaatttaatattttccacaaattttgaaagaaggcaatcaggcaaatttcatctcagtcaaataatccctaaagttacacatgctgtggctgtacctttctcaactttgtttcccttcatccagttaagacttggttgtgcagagttaggggctccgcaggtgatgacatgatcaaaggccctgacccttgtcacaagagtactcactaagaataaaagtgtttgacatcctctcagcaactctgatgtgtaatcccaccagcaattagtgtttttctttctccgcgttgattacagatagtttgcttttccctgtatgactgcaaaggtgtgtatatttgaatgtatgtctgtatgttgtttgggttgcagggaaggaaggagtagaaaaaggaataagaggtggctgtgattggctggtcgctctgaatgcaaataactctatgcttttcacctttagtgaatatataaatgtctcaggataggagcgataataaataatgccaaagatcttccttagtggtcctgtggcttcattgaaggcatacattgaaatgtttctagccaggtgcagtggcttacacctgtaatcccagcactttgggaggccgaggcaggtggatcacaaggtcaggagttcaagaccagcctggccaagatggtgaaaccccaactctactaaaaatacaaaaaattagccgggcaaggtggcacgtgcctgtaatcccagatactccagaggctgagacagagaattgcttaaacctggagaggcggaggttgcagtgagccgagatcgtgccactgcactccagcctgggtgacagagcgagactccgtctcaaaaaaaaaaaaagaaagaaagaaagaaagaaatgtttctgaacaggggaaaagccaaatgcaatgggcattcccgaaagactgaagaaagaatacgtgcaagttgattcttctggggtttccaggaaagttgggaaaagaaaatgaatcatttaaaaagtggagagctgatgcctggccctctgtacttgtttctctcagggaagaaaggcagcagaaagtagagcagtgtcccagtccacacgtgtccagggaagagaggcttctatttttaactgcagttacacaagactgttggcttttatgtttcagacgcagtgctgtgaaagaccatgtccttgtagttttcattatttcagaggtaaaatggaaagcaggagtaagagccccaatcattaagaacacggcttagctctctgcagatcacagactcagccaccaactcctgccctgtaaccatggagatgcccccacttcagtctgtacacaaccccacaagaggaaccacttactcgcttccttttctaatcagcatgaaataatatttttcataattattatctgaggcttttctatttcctcctctctatctactttgacaacataaaaatatattagggcctggtcgtggtggctcacacctgcaatcccatcactttaggaggctgaggtgggaggatcacttgagcccaggaggtcgaggctgcagtgagtcatgatcatgccaatgcactcagcctgggcaacagagtgagaccctgtctcaaaaatatatatatatacacatatgtattaggcattatgctgtacacaaagagcttattatctaatacacatgataatatctgtcactagatgtaagctttatagagataccaatttttttatccaataaccactaaccaaacaatgatcaaataaataaatggcaggttatatgtataccgatgtgtaaaggcaaatttatggccaatggttaaaatttactgaaaacaaatttcagctcgctataaaaaagaactagcaatcagagttttcccaaaaagaaacagacagctttaaggcataaaatattcctttctacaggaaatattcaaagaaaagtagaatgcccatttccagtgatgttgcagaattacaaaatgatatgattttgtgcaaaactaaaacatgtaagttttgtatgggggaaaatagcatcgaagaacagaacaaccaaacagcttgtaaaatgcatcgtgaataaaaaaagctacttccagcttaatggaaattggattttggatttgtatttgaagcatgtgtaggatttaaaatgagagagatggtaagagaatacatgccaggcaggataatcttatcaagggcaatgatcaagaaataacagagagaaaggtttaggaaattagaagtttccaaatatgactgaaagaaccaatttttattggaaaatgctgtgagataagagggaatcttggcttgagacaattgttagtgtaagaggactgcacacagcccagaactgggtttctttccagacaaagagaaaatggtatgagattatccatccttaccataaacaacattaaggaatatcttgaaattgtttttcagaaagagctaatattaacctaaatttaaactgttaaataacatcaaagatttactttacaagcacatttctaaatgtactgaaaaactatatttccataataattgattcaatggacagataaatttccttttccctgagtagttctatcatcaactaatagcccttattgcaggaaacgaaaaatctaaacacttttccgaaagtgtcgcgattccccgatcactttccagcgtgaattttcttaggggtgaggatgggaacactaatagtttctctgcactcaggaacctcataaaggacaaactttcaaatcaaataatacagaccaaataaataaaacagagctacatcttgctttgctttacacttcgttctcttccttgtctgtctgcaaaaacctttgcatgattttcattgaaaataactcctgaattgatgcgagattttacttaccctgggacctacccaggcctggtttagatatgttcccatagtcttccctgctcttccgggtactgagttaccataaggataaaccaggcagacagttcttagacattagggctaatttctaatttacccccctgtgtctttcttttatcatcacaaacatgtttggtgtctaatttggtttactcttaggaaaggatggtttggagtacataaaacagaatggttcctcaggcagcaatatgctacagttttagagatcttgtagctctatttttctattaattgatgcaggttttgagaatcaacaagcacattaaaaatagacatcaacactatagtaaaattaaaacagttattctgtcttttgttgttgtttccacattattcagaaagagaaaagtactctttaaaattagaaatggagaacaacaaggaagagaaatctattttgttgaaaaacagcttttggtaatattattcagtgaaagatgaagtgacagacgtggaaacttctagtcaaagtttgcagcttttatttgcattgaatatctatccaagatgaatcatcctagaaaagcagccagtggacttggaataatctcgctcaccatggtttctgccaaggaaggattttcttggcgcagaatgttgggtatttatttggggtcttgaatgggtgaaagagacaaagaacaatttacgagaaagaaaggagaagaaggaatggatccatggacagaaaagatttgtcctcaagggtacatccaagatttgctttaatctgtcatataatggaaatttgaaacagttattagcacaggttcacagcttctcaaaactaaaaaccattgtggaaaagaggctaagcacaaagatgtaagcactaaatgagtataactgctttgcagacagtttcatgtcagtggacatgtgccatttttcttctttttttttttttttctgcccagtgcagctgccacatattattcaatgcacaactttacagggcatcattcacatcttagtaagacatggagaaagacaatgctgagataaagaaaagcagatttccgagagcatcatcagagcctacaaattcagctctgcctggagctgcaaaagtcaaaatattctttttggggatcaagccagcatgaattgagattctgtcatttacagccaatggattcataattctcatagccaaaagggagagggatacttttggttctctgttattttatgagctgaatttatggtccacagaagcattttctactcaaaataactagagttatgtaaagacaaataatcattggtctactctcattatgggaaataagagccataataaccctatgtgtgttttatgaatttcaaatgggaaaaattttgaaaactactaaaaattcataactctacattataaacataagaactcttactttttctatttttactttttaatttccacttttgttactatttttacttattttccttgtttacatttttgcacatgaggaaatcatattgtaagaataattttatgaaattttattctcatttttagaattaaaaatgccttggatttatagtttgaattggctactatttcacaccgtagatatacaatactttataattttcctgattggggatatttttattatttatttccaatttttattattttaaatagcattgtggtaaacatctttaaatatacattttattttatttatatatatatttttattatactttaagttctagggtacatgtgcacacgtgcaggtttgttacatatgtgtacatgtgccatgttgttgtgatgcacccattaactcatcatttacattaggtatatctcctaatgctatccctcccccctccccccaccccacaacaggccgtggtgtgtgaacttccccttcctgtgtccaagtgttctcattgttcaattcccacctatgagtgagaacatgcggtctttgggttttttgtccttgtgatagtttgctgagaatgatggtttccagcttcatccatgctacaaaggacatgaactcatcattttttatggctgcatagtattccatggtgtatatgtgccacattttcttaatccagtctatcattgacggacatttgggttggttccaagtctttgctattgtgaatagtgccacaataaacatacgtgtgcatgtgtctttatagcagcatgatttataatcctttgggtacctacccagtaataggatggctgggtcaaatggtgttgctagttctagatccctgaggagttgccacactgtcttccacaatggttgaactagtttacagtcccaccaacagtgtaaaagtgttcctatttctccacatcctctccagcatctattgtttcctgactttttaatgatcgccattctaactggtgtgagatggcatctcattgtggttttcatttgcatttctctgatggccagtgatgattagcatttaattttcatgtgtctgttggctgcatgaatgtcttcttttgagaagtgtctgttcatatccttcgcccactttttgatggggttctttgtttttttcttgtaaatttgtttgagttctttgtagattctggatattagccctttgtcagatgagtagattgcaaaaattttctccaattctgtaggttgcctgttcactctgatggtagtttcttttgctgtgcagaagctcttgagtttaattagatcccatttgtcaattttggcttttgttgtcattgcttttggtgttttagacatgaagtccttgctcatgcctatgtcctgaatagtattgcctaggttttcttctagggtttttatgattttaggtctaacatttaagtctttaatccatcttgaattaatttttgtataaggtgtaaggaagggatccagtttcagctttctacatatggctagccagttttcccagcaccatttattaaatagggaatcatttccccattgcttgtttttgtcaggtttgtcaaagatcagatggttgtagatgtgtggtattatttctgagggctctgttctgttcaattggtctatatctctgttttggtaccagtaccatgctgttttggttactgtagccttgtagtatagtttgaatacaggtagaatgatgcctccagctttgttcttttggtttaggattgacttggcaatgtgggctcttttttggttccatatgaactttaaagtagagttttccaattctgtgaagaaagtcattggtagcttgatggagatggcattaaatctataaattaccttgggcagtatggccattttcatgatattgattattcctatccatgagcatggaatgttcttccatttgtttgtatcctcttttatttccttgagcagtggtttgtagttctccttgcagaggtccttcacatcccttataagttggattcctaggtattttattctctttgaagcaattgtgaatgggagttcactcatgatttggttctctgtttgtctgttattggtgtataggaatgcttgtgatttttgcacattgattttgtatcctgagactttgctgaagttgcttatgagcttaaggagattttgggctgagacaatggggttttctagatatacaatcatgtcatctgcaaacagggacaatttgactttcccttttcctaattgaataccctttatttctttctcctgcctgattgtcctggccagaacttccaacactatgttgaataggaatggtgagagagggcatccctgtcttgtgccagttttcaaagggaatgcttccagtttttgcccattcagtatgatattggctgtgggtttgtcatagatagctcttattattttgagatatgtcccattgatacctaatttattgagagtttttagcatgaagggttgttgaattttgtcaaaggccttttcggcatctattgaggtagtcattggtttttgtctttggttctgtttatatgttggattatgtttaatgatttgcgtatattgaaccagccttgcatcccagggatgaagcccacttgatcatggtgcataagctttcggatgtgctgctggattcggtttgccagtattttattgaggatttttgcattgatgttcatcagggatattggactaagattctcttttttttgttgtgtctctgccaggctttggtatcaggatgatgctggcctcataaaatgagttagtgaggattccctctttttctatttattggaatagcttcagaaggaatggtacaagttcctccttgtacctctggtagaattcggctgtgaatcatctcgtcctggacttttttcggttggtaagctattaattattgcctcaatttcggagcctgttattggtctattcagggattcaacttcttcctggtttagtcttgggagggtgtatgtgtcgaggaatttaaccatttcttctagattttctagtttatttgcgtagaggtgtttataatattctctgatggtagtttgtatttctgtgggatcggtggtgagatcccctttatcattttttattgcgtctatttgattcttctctcttttcttctttattagtcttgctagtggtctatccattttgttgatcttttcaaaaaaccagctcctggattcgttcattttttgaagggttttttgtgtctctatctccttcagttctgctctgatcttagttacttcttgccttctgctagcttttgaatgtgttttcccttgcttctctagttcttttaattgtgatgtcagggtgtcaattttaaatctttcctgctttctcttgtgggcatttagtgctataaatttccctctacacactgctttaaatgtgtcccagagattctggtatgttgtgtctttgttctcgttggtttcaaagaacatctttatttctgccttcatttcattatgtacccagtagtcattcaggagcaggttgttcagtttccatgtagctgagcagtttggaatgagtttcttaatcctgagttctagtttgattgctctgtggcctaagagaaagtttgttataatttctgttcttttacatttgctgaggagtgctttacttccaactatgtggtcaattttggaataagtgcaatgtgttgctgagaagaatgtatattctgttgatttggggtggagagttctgtagatatcaattaggtctgcttggtgcagagctgaattcagttcctggatatcattgttaactttctgtctcattgatctgtctattgttgacagtggggtgttaaagtctcccattattattgtgtgggagtctaagtctctttgtaggtctctaaggacttgctttatgaatctgggtgctcctgtattgggtgcatatatatttaggataggagaattgatccctttaccattatgtaatggccatctttgtctcttttgatctttgttggtttaaagtctgttttatcggagactaggattgcaacccctgcctttttttgttttccatttacttggtagatcttcctccatccctttattttgagcctatgtgtgtctctgcacgtgacatgggtttcctgaatacagcatactgatgggtcttgtctctttgtccaatttggcagtctatgtcttttaattggagcatttagcccatttacatttaaggttaatattgttatgtgtgaatttgatcctgtcattatgatgttagctggttattttgctcgttagttgatgcagtttcttcctagcatcaatggtctttacaatttggcatgtttttgccacggctggtgctggttgttcctttccctgtttagtgcttccttcaggagctcttttagggcaggcctggtggtgacaaaatctttcagcatttgcttgtctgtaaaggattttatttctccttcacttatgaagcttagtttggctgaatatgaaattctgggttgaaaattcttttctttaagaatgttgaatattggcccccactctcttctggcttgtagagtttctgccgagagatccactgttagtctgatgggcttccctctgtgggtaacccgacctttttctctggctgcccttaacattttttccttcatttcaactttggtgaatctgacagttatgtgtcttgtccactccagaccctgtttgcctgggtatcagcagcagaggctgcagaacagtgaatattgctgaacagcaaatgttgctgcctgatcattcctctggaagtttcatctcagagggatacctggccgtgtgaggtgtcagtctgcccctactggggtttgcctcccagttaggctacttggggtcagggacccacttgaggaggcagtctgtccattctcagatctcaaactctgtgctgggagaaccactattctcttcaaagctgtcagacagggacatttaagtctgcagaggtttctgctgccttttgttcagctaggccctgcctcccaaggtggagtctacagaggcaggcaggcctccttgaccttcggtgggctccacccagttcgagcttcccggctactttgtttacctactcaagcctcagcaatggtgggtgcccttcccccagcctcgctgccgccttgcagttccatctcagactgctgtgctggcaatgagcgaggctccgtgggtgtgggtccctccaagccaggcacaggatataacctcctggtatgccctttgctaagaccattggaaaagtgcagtattagggtggaagtgtcccgattttccaggtgccatctgacacagctttgcttggctaggaaagggaatttgctgacctcttgcacttcccggatgaggcgatgcctcgccctgcttcacctcatgctcagtgcgctgcacctactgtcctgcacccactgtccaacaagccccagtgagatgaacccagtacctcagctggaaatgcagaaatcacccatcttccgcgtcgctcatgctgggatctgtagactggagctgttcctatttggccatcttggatccacccctaaatatacattttaatttaactttttatcgtttcattaagacagcatcctcgaactggaattagtggttcaatgggcaaaacagctttatagcctgttggttccttgtctgtcttaatagcataacaccttttaaaagctttctaaattccttatctctactccctaacccctttcttactcaaaacccagtccaggcagatttttatccctatccttgtatcagaatcactttgttaaggtcacaatgggtttcatagcctcaaatccaatgatccattaccatgttttatcttactgaatttctcagaataatttgacaatttggttattctctccttgaaacattatctttgcttgagtttggggattccacactttcctggtttgctttcaacctcacaagccactccttttctagctcaccttcctcttgctgacctctagatactgtgttgtctcaggactcagtcctcaaacatatatgccgtctacatgcactctctaagtgatttcatccaggaatatggctttaattaccatccatacattgatgactcccaggtttatacctccatccaacccctctctgttgaaagccaggctcatatatactataatctatataacatctttgccagatgtctgtctggcatctaaaatctaagatatccacaacataccttattccctcccttacgctcatccctcactcttccccatctcaagaaaacagtgatataattcacccactcgctatagccaaaaatactggaatcttctttaattcttctctttcccccataccccacattgtcaacaaactggccacataagatgtgttttctgtcagaaaaaaaagcctgacttcattttttaattcaaataagaatgttacatgatgggttccaatgacaacccagtcatttcataattctaattctaaagtaggtagatgaatatggtaaggaaccttgcattgaggctgtcgccagttgaaatatattcctgttttgcaatatttcttgcttagcttttaagggctctcccgcagattccagaagctaataaattgtctctttatttggcagcttgggaattttttttttagcaccctggaccaatgcaccattccggatggttgagatatatactttttctttaaggggtaggaggtaagggtgatgttggaaagagaaatgggaaagaagcagcagcttaacatttggaccctgaagcatgttctagagcaggctggttttaagaaagtcctcatttgcctcaaggtacgtgaccccagtttaatgactataggcctaaatgggacaggatcacaatcacatttgtcaccagcagactcatatctaggaggcatacaagttattcctgttagaacagtgacttactggaaagtcatttcccaccactgatttgagtcgctgttattatcgtacatgaatttccatatacaattaggccatattacagatttgctattccatttaactaacctgtctgcctacccttaattttcacttaagaattttctttctctttcttttcacttctgtgcaatagaaaatatactcttttcttctacattttcttctgtttttttttgttttggcataagaatgacaggaattttttaaatgtttaattgtagccaatcctttgctagtggtctttgtcctcttttaggttttctgatgtacagtcattttatctacttacatgcagatgatgttttatctcttcctttccaattcttatgcttcttattgtttctctgggctgactgcattagcaagtagcttcaacacaatcttagatagcagtagtggtaatgaacatctttttccttcacctactttaataggaaagcctctagcactttcccataagttggtgctggtttgggattacggtgtatgcaagttttatgtgatatgttaaagaattagttattagtttttatttttcaatgttttaacatgaatctgtgttgtattttgtcaaattccttttctccatcaataaagataatcatatgattttttttcttggctcttgtatcagttattaagctactaactcttacctacaattgcttagctcctatacctcgcttctagagtagtaactgctgatgtcaatcatacactggcccctagagctagttgactttttaggtgtgtttttcttctctctccaactggataattagcatattctattttgtacattttattaaatgtctccacagggttaagtgaatttgttgaggtagtgacactcaacatttattgtttacctgccacaacccctgtccatcattgctcagtaaaatcgttaatcatctatagctagacatatacctgctagtacctacctagaatgttgaaatcacatacctgagataagagagaagaaaaattccaaggagaactctcatgtaaatgctacttcctccaagcatctaaaacagctcctctattctttctaggaaaaaaaatcccttctttgaggacattcctggtaagtatcctcataaatagaaaaaaaattttacaaagagaactaaagttttgctagcatttctgtggtttcagacttaatgtgatgtggggatgctctgattgggaaaaagaaagatcataaggtttctagggaagtgtaccagtttacaaatagccagattctccagtgaccacctcatgtgtctattgtttttttctcaagcagaaatgtgaaaacaggagaaggtagagtccagtcttacccaaaccctgcatgtccaggagaaagctaactctagtctaagctacaaaaaacgaaaaaaaaaaaaattctccttgttttacataatttcatacacaaaaaagaatggaagagtaatatccacaattaacatcaaagatcctcttattcttcatagactcagtgtagaggctcagacacttatgtcatgaccacagaaagaaatgaaggaagaaaagaatgaggatagatttgctagggccagggctttacccaagaaatatagctgagaaaatgtgggagggtaataggtaggcacctatgctccacaggatgagacctggatgcaaagaacagatgagagctttcttccctatcctctcctcatcttgagtccctagtcattgctgcaagtacaggaaaccataaaacagagtttcagaaaactaatatgtaaaacatgagaaattaccagtgtgcacaggtgcccagagctaaatataaagcacttggatatttgcaaaagcactagcatgctcagagttagccagttactagactgctttctcacacctgaaaacatcctaaaagaaaggatactacattttcctcctttgtctttttaacgagaatttggaaaaggtctaactcttttaacttatttaaagctgctgagattgagacatataatacagctctggtagaaaaataatcaattaagggaaataatcagatcttctctcaacctattcctacccccctcagaatgtactacagtgccatagaggcaaaaagcctgcataattctttaaaggtgaggggagtgagggagtttcaggtgtaaaggattttcagacagtcataactggagaaactttccttttaacactgtttgctttctttcttttttgtttgctcctcacctctctgtatgttccgtctacctttcatttcaacataacgagttactttatattaagggggaaatgaaaaaacaatttttttgagttcagaccacctgggggcagtgcttcctttgacagaggcactgccagaaactagaacaaggggaagggaacagcaggaggagggcattcaatgatgtgtgtgatgtaacagtgaggttttgattatccgtaaaaacaatgaagattccccaaaggctacccaaccaacagaaccagaagactctagaacagtgaactaggcccagtgaacacggccaaatctaggtctccaaactgaatccacagaggctccaggaaaaggaaagaatggaaactccactgagcactctgctgctgctcctctgtgtgcagctgacctgtgagtcaggcgagtcatgaggaggggaggaatcaagtaggggcggccagggcattgaaatttagaaagatcccggggacaatcttgggtctagtctcaggaatgtaaaacaaataatgaaactgatgaacaaacacactatatatatgaaaatgtttcattcctcctaagcagggtcaaatggacaactgccagtggaacagaatgctccttccctgaaagtcaaggaaggtgacagcgtcacactgaactgcagttacagagacagcccttcagatttcttcagtggttcaggcaggatcctgaggaaggcctcatttccctgatacaaatgctatcaactgtgagagagaagatcagtggaagattcacagccaggcttaaaaaaggagaccagcacatttccctgcacatacaggattcccagctccatgactcaaccacattcttctgcgcagcaagcacacagtgcccacagtcacctgcacccggtacctaaagcttgctgaggggcctgggcacacctccttttataagggccctggggcactgactataactctgctgcatacaaagggaaatatgagggactgttttataacataatatcaaacatttcatttgaagaccatgtgaggaaggatagtgttttcaaataccatctaaagtactttgtttctcagtgtgaggcccttcctttgtgaaaactagcccaaaaactagaggctaaatatcaaaaaggagagagcactaaagaacaaagaaagaacagggtaaaattcttgtctttgagcttctttgtagacttttacaaagatatagaaaatacaaaatcttgaaagccatgaccatcaaattcagtagtgaaaggaaaaatattttgacatgccaaaaagattggcttagaagatcaagtaccaaaatctgagggaaaattgtacaaagcatttaaaggaaaagagaacacaacatggtagaaaagctgtcttctccttaaaagggataaaatgccaaccagctagctagaaaggaagtcaatgatgtgaggagaggtcataaacagtgagtccagcatcctgctcttttctagggtcagagctctgagcaggtagggtgggaggagggtgagtcacatttagcaatgactctgaactgaaggaacagtgaattttggcaaaaactgttttgatcattgtgtcttatatcaatactcacaagaaaacgcccattacagaggaagcattcaacaaccatgtggacaagacggtcggtccaaagcatgtcagccagccagagaatgtctgtgcttgtcaatttcttgaacaatagacccatgaatagattagctgaggtgacagattgagtttctttataagcccagaagcatgggttttctcccaccaagacagattcagctacttctgctgctgtcacaggacttttccttagttcaaagacagggttcttttcccatgggcacgaaaattcaggctcgcaaacaatttgaatggtgagtaagacacggttttattgggtgaagaggaagaaaagggggaaacagggactcttacaaggccagagtccctgctagagcacttcccaccccgcagttcgaatcccaggttccacacaggaagaggaggagcctggctcctccccactgcaaaggatgccaacttctgcggctccaccccagtgcacaggctgcttggaatttctctagggaccccctcccacctggctgtctcactaccaaatgtccaccctgtcagcagtaaatacaacactgagccttcgatgtggaatcatccttcaaaggaaccagccacacactagttggcaagttgattacattggaccacttccaacctggaggtattaggaattttttttcttcttaatacatattctgggtgtgaatctgtggtctcctccaaagtgccacacatagttgcatgaactgatggctcagagtgtctcattgatcattctgatcatcaaaggatttcacatcccttgcatcaacagacccactttatatcaagggcgtgtgacagtagtcatgtcatatagcatatagcttcatcatacagcattagccatgaaccactagcctgatagaactttggaatgaccacttaagggcccagctaaagcaccagcttagggacagcaccctgaggggctgaaaagctattctttgagatagtgttgtgtccctgttacataaaatacatggacctgggtagcaagggatggaagtaggactatcaccccatcaaccaccactttcagtaacccacttttgtgcttcctgttcttataactataggttctgctggactagggattctgtttccctttgagggggaaaagggaggatgctgcttctacgagggaaataggtttttaccaaacccaagataatatatactacctcataatttggggatcttcatgccagtcctggaggccaagaaaggagttactactgtcatggacaagttgatcctgattatcatgaagctaaaccccatagcggaactggggatatatgtctacaactcagggaattcactgtgatgacttttagcactttcatgtcagtgattatcgtaaataggcaactgtagcaactacagcctgacaagagcagactaaccaggggcttatacccctcggtgatgaaggtctaggttacctccctggaaaagaaatctagagcagtagaaaaaaatgctagccgaaggtggggagaatcaagaataagtagtatagaaggtagatggaggagataataaatatgagttgcagtcatgcaactaactataacaaacgtaacttgtcccagtaaccctcttgttgtcaaaacaacatcaacaacaaaaactagtgatctatatgaatttaacacacagcacaagtggatctgagcaaggcaaggagtgaactgtatagatactgttggttccctacctatatctcctaggcagtcacgccaacatgctggacaccactcgctgaaaatcccagcaaccctgaagatgactttgactttctggccatgaatgtggaggctgtggaggacaagccagaaatgcaaaagagttaatgccccaaaagcagttcttaatcagtgatagacagggagtttaggcatgattactccagtttcttcatgactcatttggcatagctccaaagagtatgctatgctgtctcttagagttattgtgacaggtagttagacaggcatgaatggggcacaagagagctctcccctccacccaccaggagtcatcaggcgattgttcggcagttatcacattacctctctaaaaatgataattggcagcaaattatcactggcaacttccccaacagataaagacacttaagattggtaatcagcttccaataaaatctcaggaattggtgagtgaacccagcatgtacattaagagacaaaacagcagagtatgaccttctgtgggcactccaccagaaaaaggaagaaagcctcagatgtgcatgagtacaacttcctaaacacactgctcatgcccacgtcccaagcaggaaggagggcactgcacatgcgggcagcccatcctaagggaagaatcatgggaaaggggcacaagatgctggaggtaggtcagtgtataaaatcttaggattaaggttaaaggctgcacttgtccttccagttgtccgcttgggtctcttccaagtgtactttcctttctctcctgctctaaagctttttaataaaattccactcctgttctgaaacttgccttggtctttcattctgccttatttccctcagtcaaattctttctgctaaagagacaagacttgaggttgctgcagacccatatggattcaccaccagtaactcagagccttctacccctaacattatccagctgcagaaagctgcaattgcccatcgtggtaactgccttgatggcacattctgtattggcttccttccttccctgatttacctcttacccatgtcttgcaaacaaaaaagagttaaactctgtaaaatagttaaagaggttgattctgagccaaatatgagtgaccatggcccatgacacagccctcaggaggttccgagaacatgtgcccaaggtggtcgcagtgcagcttggcttatacattttagggaggcatgggacttcaatcaaatacatttaaaaaatacattggtttgatccaggaaggtgggacaactcaaagcaaggggcaagggggtcagtgggagtgaggagcttccagcttataagtagatttaatatttttctggttgacaattggttgagtttatctaaagacctggaattaataggaaatgtctgtattgcgataagaggttataaagaccagagtttggtcaggcagatgaatcttccaagtagcaggtttcagagagaatggattgtaaatgcttcttatcagacttcaggtctgtgttgatgttaatgccagagaggtatgatgaagcatgtctgacccccacttcccattctggcctgaaccaatctctcaagttgaattttaagagagccctggccaagaaggaagtccactcagatggttgcggggggctggggggccttagaattttatttttgatctacagtttcctagaatcacctataataaactatttacacacaaattattgtgtcgaagctgacttttagggatccaaaaccaagatacaggaattcaaatcatgagacaagggtgaagattatccagaagaaatgttggtgccccttctcttattgctaccaagctgagctttgcagcacaagggattttagcagtctcattcaggatgggccccagtgcttacaaactccttaagcatctctctgagaggggacactcagccacctacctctgtgacagagaactcatgctcctcacacagcacccagtacataacagggcccccattcataatgcccagtttggggaccccaactcaggaattacataaggatccctgatgctccctctggaaatgcaaaattctaaagaatcagagtaaggtatttaaaaagagtttttttcacaatattttttcaaaatggaatgaaaatgataagagcaattcttgatataaatataaattaagctgaggcaatttagtgctgatgagaacttctgcaatagttatttcagagcttcttgatatagcataaacaaggtggttttgtttatttgtttgtttgcgtttgttttttgagatggagtttcactcttgtcgcccaggctggagtgtggtggcacaaactcagctcactgcaacctttgcctctcaggttcaagcgattctctgacctcagcctcctaagtagctgggattacaggcatgtactaccatgcccagctaatttttgtatttttaatagagatggagtttaaccatgttgcccgggatggtctcgaactcctgacctcaagtgatctgcccacctcggcctcccaaagtgctgggattacaggtgtgagccaccatgcctggccaacaagattatttttttaatccatgtaaaatgtgaacacaattacacactacatattctgcttttacttatctctgaatttagtcgatgctcttttcagccacaagcatatatcttttttctcattctttattttgagaaattataaaaatgtaaaaaaattgaatataaataggcatattcttatcactcaaaattaagtgtccttatttcataagatttgctttgtaattttttttaataagaagaaaaataaaatcacagtttgccatttgttgtgaatggagtcagaggcttctgctcaccattctggatcacgctctcctctccaagattaggtcgtattaaaaacaaatttgccagctccattttctctttatttttcttctaggctaactaaaagcactccagaaacattttttattttcatttgaaattataaccagaggcctattttctgagagaccaaaaagtattcagaaatgtttccctccttgaaacctagtcacccacccacctatcatagcatttcctgccctgaaggagaattctcaccaagcacagaggagaacccatcagagcaggagacttttcactctgcaggggagcgctgtcagcatgacacgagttagcttgctgtgggcagtcgtggtctccacctgtcttggtaaggaagatgtggttctttctttataaaggcatctaatggggctgtgaagcaggagggattaacagaacagcaactgcattgcctcttagagcccagctacctggaggcagaaatatgctgcctgaggctagaatcacaaagaaaggtgtgtgggaatggggaatgggaatcagcttgtgagtctgtttctcactcacacgtgatatcccagtgaagtcctttctctcctattttccacagaatccggcatggcccagacagtcactcagtctcaaccagagatgtctgtgcaggaggcagagactgtgaccctgagttgcacatatgacaccagtgagaataattattatttgttctggtacaagcagcctcccagcaggcagatgattctcgttattcgccaagaagcttataagcaacagaatgcaacggagaatcgtttctctgtgaacttccagaaagcagccaaatccttcagtctcaagatctcagactcacagctgggggacactgcgatgtatttctgtgctttcatgaagcacacaatgagatgagcagcagggagaggcttacagaaacctcagacctcagcatctgtgcaaaggtcacagggtgagagggaagtggtagggtaataggtatagaaaatcattgacttctcttggaaatgaaagcttctcctatttcttctcctgtaagaaactcagagagatggctgtctgcaagcttcaatccttaaagttacataaagataatgacgtgtgcagtgcattccagttttacaaggtgccttcactaaggtacttattacaggtcagatttcctaagcattttctctgtccagaaaatttttataatttgcctgggcattcttacctccaggaattttaaaccttttccatttgttaattgttgcttgtccttttatttgtccatctggtccaaaactgcatctcctccgaataaggtacccattttagaacacaacaggtgtgacaacggtggcataaccacgaaggggacttgctgggcccaccagactcaagagatgacctaggtccactgcagtagaacctagaagaatgatgaaaaggctttaaaatgctccgctgaagggccagctcgtgggcaacacctcagtggttggaatgctatgcttcagaaaatgataatattcgttaaaccactggctgattcatggtgtcgtggcaaaagtttagaaaccaagaaatagacatagaatagagtcttctcctatcactccctataagtcattttcagaattcgtgtttccctttcccacaaccctaggttctgctagattagaggtcctagttcccaaagaaggatgctcccttcggggattcagtaacctgcagctatggctgccacttttaggtcactctgaactctctgtgccaatagcccagcaggcaaagagaggagctattagaccagaaggggtcattgaccctgactgtcatggagcaccaggttgttgtgacacaaggagggtgaggaggaatgtggctataatgtaagtatttcacattggtgtctcctgatgtttccgtgcccaatacaaacagcaagcggcagttcttgtagcagcaaggcctgaaaagggcaacgtgaccaagaactgagactcttcagcaatgaagttttcaagaacagaagctcatgtcatgcaaccttcctgtattaagggcgttgaagagattgcagtcagaggcaaccttgaagacacagtgacacagtggaaataatatagggcaagcatgcatctgagtagtgcaaagaaaggactgtaactgatatatgcgccctgttgccccatccgaatgtctgtctgattttagctggagttatagtagacaatcacactcacgtcatgctggtaacatccagcgttaagcacactctgtgttttgttatgttatgttttgttttgttttgttgctttctatcccaaagtcttctctaatgtctcaggagatcccttagtttaagggcaagcacagcctgaaattatagggaaactaccacccctgttggcaaacaccaaccaatggggaaaaagagccagggaataaacgcactagctttgcgtcccttaaatagacaattctgagcggcaacctgtgtgcttcttgggagatcctaccagaaccgagtcccacttgagtcagttattgctcgacccactttcttcttttataacttatttttatagatcaagggagtacaagtgccacttttgatacatggatatattgtgtagtggtgaagtatgggttttcagtgtaaccatcacctgaatagtgtacattgtactcattaggtacttttcattcctcattctcctcccacactcccaccttttcaagtctcaatgtctgttatctttgtccatgtctatgcattatttagctcccatttataagtaagaaatgtagtatttgaatttctgtttctgagttacttcacttaagataatggcctccagttccatccatgttgctataaaagacatgagtttattctttttatggctgagtagtattccatggtgtgtgtgtgtgacattttctttatttaatcatccatccattgatggacacttaggttgattccatatcttttctattgtgaatagtgctgtgataaacataacagtgaagttatatttttgatataataatttctttttgtgggggtagatacccagtagtgagatgctgggttgaagagtagttctatttttagttctttgagaaatccctatactgttttccacacaggttgtactgatttacattcccaccaacagtgtatatgtgttaccaaacatctgttgttttctgacttcttattaatagccattctaactgatgtgagatggtatctcattgtgcttttaatttgcatttatctgatgattagtcgtgttgagcattttctcatgtttgctgaccatttgtacgtcttctttgagaaatgtctgttcatgtcctttgcacacttttcaatgggcttatttgtttcttgcttgttgagttgtgtgagttccttgtagattctggatattagtcctttgttggatgcatggtttgcaaatgttttctctcattctgtaggttgtctctttactctcttgattatatattgtgtggtacagaagctatttagtttaattaagtcccattagtctattttttgtttcgttgcatttgttttaagatctcagtcataaattctttgcctaagccaagatccagaagagtttttcccaggttttcttacagaatttttatagtttcaggttttatatttaagtctttaatccatcttgactttatagtaagagaaatggatccagtttcattcttctgtgtatggctaactaattttcccagcactatttattgaatagggtgtcctttccccagtgtatgtctttgtctactttgtcaaagatcagttagttgtaggtatgtggctttatttctgggttccatattctgttccattgatctgtgtgtctatttttcatacaagtaccatgctatattgatactatagccttgtagtatcatttgaagtcaggtgatatgatgcatcaagatttttctctttgcttaggattgctttggcattcaggctgtttttttgtttcatattgattttagcattttttcctaattctgtgaaaagtaatattggtattttgataggcattgcattgaatctacatattgctttgggcaatatggtcattttaataatattgctttttccagtttataagcatgagaggttttttcatttatttgggttatccacaatttctttcatcagtgttttgtagttttcctagtagagatcgtttacctttttgtttaagtgtatttctaggtattattttgtggctattataaatgggattatttattttgtggctattataaatttagtttgtagcttggttgttactgatgtatagaaatattactgatttcatacattgattttgtatcttgaaactttactgaattcacttatcaaatctgggagtcttttggaggagccttgagggttttccaggtataagacatatcatcagcaaacagatagttggactttttcttttccagtttggatgccttttatttctttctcttaccaattgctctggctaggacttctagcactattttgaataaaagtggtgagagtgggtatcctgctttacccattttctcactcctgcttcctgagatcacttcctaaataaactacctgcacccaaggtagtttcaggctctgtcttggggggaaatcaaactaatacagggaatctttggaaatccaaagattctttgaaaatttaacaaagaaagaacagaggagagttcaaggtgaaccttactgggctaagctaataaaggtaagtgtgtacttgagtgagaaattgtaaaaaaaagatgatgaggcagatcgcatttactaaactccaatctctgcagatatgtgattacgtcttttcagtgttcaaaaactttactttccaagtttaagctctttcaactgtctctcatttccccttcccaaatcttctgaccctttactatttaaacttcattcctagttattcccaaaatacgtctctcttctagtcagtttattccccttactggctcataaggacttaaagctcattgctggctctagcatttctctactggttgctccacccacccaaatttcccttttgtgtatatttcagactgcttaaaccatattaatcttataatgaccaccagaaatctctcttccctctaagatttcttctctaataatcaaacaatcctttaattccttctcttccaaatgtcatacagtaccaactgtggaccaaacaatccgactcttactgacataccttcctaagacatttgctgttgtttcaaggtactcatctttcctccccaaatacattatattctctatgtagatagagtttgccttgtacccttcacaattcctcactgctcttagcacagtactaagcacataataagtgctgataaggcacaaatatgcttaaggtttaaattataatcatgctatatttctgaaagaatatgaaggaaaagaaacaggtttctctgaggaggtaagatgtgatagaaggtagaatttaagaaagcagtgataaaggaaaggacagatacatttcaaacatccaagtcttttgatttagtggaaacataaatctgaaactggtaaaaagattacttttagaatacatttcttactaaaccaagttctttccatacagaaaatcctagaaactgcctctgtaattatctctttgatctgaagagggcactgtttgctcctgttgatagcagttacttacaaaaaaccgatctcattttgaagaatccgctattcctaatacatacaaaataactagaacaaatcctatgttatccgtagagtctaggtcagatttccacattctggaatcaagttttccaccaattaaaaaggtcaaaccatggaggagcttttaggaactgtatttgtgatctggtggctttggcctgggtgagagctgagtgaattcatttcatcagggacacagaggactcagaaggttctgagaactagtctctatattttacagaagggattcaaagaataaataaaacatttaatttaccctttatttaatttacccttaattcatcttttttaagaaaatttgctatcaaatgaaggaagaggaatgctcttctgaccatctgtccagagagacacaaccaatctctgttctccagagagacagagccaataggatgaatatatagatatatgagaggggatttattagaagaattggctcatgcaattatggaggctgaggagtcccatgacagactgtctgcaagctggagaacctgggatgctggtagtagtgtgactagtccaaatccaaaagcctgagaacccagggggccactggcataaatcctacagtccataggccagagatcccagagttcttgtgtctaagggcaagagaaaaagagtgtatcccagctccaggcaagagaaagaccaagttgcttttcctaggtttctgttctatccaggcctctagcagattggatgcccacactgaagatggatcttccccatgtattccactaagactcacaagccaatgtcctctagaaacaccctcataaacacacccaaaaataatgctttaccagttctctaggtattccttaattccgtcaagttgacgcctaaaattaactatcacaccatccatgaaggaaagatgttttgtcatctactataattatttgaacaatgtttcagatccatgggacagaatgaaaaagatctagaataaatctgatgtctttgtttctgttcttgttaactagggttttgtagtgcaggggaagataagcagcctccttcagtgctagtaccagctccctctccctgaaccacaagaccacccagtcgagggacttagccatctatgtctgtgctgcagggaacctacatgcccctgaaagcacctaaatgcaccaccccctccaccctgcattgggacctccactcaggggttagtaaaccatcttcatcacctcctctgaccaaaagaatattgtaaatgaatgtaacaaatcagagaaaatcttttctaaaagacttttagaaagctttttgttcactgtattatcagataaggaattcagagtcatgagaaccctgatcatgagctgtctgaggtgattaggaccagggaccctgagtgttctttcgtcaagacccactcatctaagaggggctgtctcaatgattggagcggcttctcccacttgtgccattaattgctggtatgcctcagtttttgcatctgtaaaaattctcccacgagaacctgagagtaggcgtgtgatactcacatatttttctcctagtttttactttttatagtctaactagctaactccagtaagaaatcccatgatggtagttgccagatagggttgatatcccaagggagcacagtaaaatttctcagactgcccagaaggggttctgcttccacaaaaaagcagccgtctgcccaccccacccgtatttgcccacttgcaagttcttttatatacatcgctttatttggtcttcaatgttcaataatttgattaactgtggaagttggaactgattgaatgataaatacaagatactaaagttctgattgcataggtcccagaggatcacaaaaaagatctaaagtggcaagatctatctatggccacaccaccccaaatgtgcccaatctcatctaaaatggcaagatccattcagcattgcagcactggaatccccagtcagcattgcagttgcaggcccagtgagcccaggcaagaggcggaaaacatttactcttgagaccctaattagtgaactcatagatagctgcagctggcctgagactgggagagaagacagcccaatcgtctggagcttcctatacagactagagagtggtggcacatgcctgtagtcccagctactcggaaagctgtggtgggagcatcacttgagcccaggaggttgaggttgcataattgcgccactgcactccaacctgggtgacagagtgagaccctgtctcaaaagaaaaaaaaagagaggagaagggggtaaattgtaaaataatagcatatttgccaatttcctgtgaatttgtccagaaaatagtaggtagtgcagaaatttaacaccacgcaaacaagaaaagtagaccacctatggaagaaactcaacatgctgtactttaagaagtcctccggagttaagaacggctgtggcaaaatgcccactgttagcaccatttccaagtggaaataataaatgggaagggagagttaagaccaccactccctatacggcaagtcagcttttaatttagtcttttattctccttcttgttttacagggggaaaagtttacataaagctgaactatacagaagccttatctaagattggatgacacaaattaaatagggagagaaaattaatgcaaatgaaactagtagttctctgtattgtgagttttcatttttgctctgttgcctcttctataaaatgcagactaattcctgacctttcctccctcaaagaagaatgtgtgcatgaggaaaaaatcagatgccaatgaaaagctgtcagatgtgcaacacagaatgttcccaaatgaattttatgttgattgttctgagtcttctttcacaaagtcattaacagaagctcacaaaagcccttgccaccagtattgtagagctccttgacacagccaaaatcaggtattctttttttaaaaaagaaagtcttcagcaaattacagtataattagatatcaaaagtctggtttcaattttctctagactatctgaatgttattgttgttgtcattatttttcatcatttctcaaagtattaaaatacaatttggtcaaacaataatataaccaatacctgtattatcataacccagagataattttctgatattggcttcaagacagaggagggaaagaaaaaaaggaaagaaggaaggaagaaaaaaaaaaggaaaaaagaggagtaaggggaagggaaagagaaggaaagacgggaaggaaagagagagaaagagagagagaaaggaaagacaataaaagcttatagagaaaactgaagtcacagcattagcttggcctgtcttttccccacccatctcattctcctatccaaattatgtctttaaaaaacaatgtatcagctccctttcctcttcatgtttattcccaaataaattacagttccaacaacatcttttttcgttaaatattatggtccaagttttattctctgaagcaaaagacaaaaagtatcgaagagctttccctaagggagacatcataaacagcccacctgacatcccatttcctgttctgaagcagctacggcaccagtgcagctgatactcaaggttcagatcagaagaggaggcttctcaccctgcagcagggacctgtgagcatggcatgccctggcttcctgtgggcacttgtgatctccacctgtcttggtaaggaaggcgcatgtattcaccttaactagtattcaatagaacagagaagtgggaagaaagattaatagtgcaagaatctaatctcttcactgggcccagctattaggggcaagaaagctgatggattttgtcagaggtttggatcaagaggaagaaaggcgggtggcaatgggaacaggcttgtgagtctgtttctgtctctcacatggtatcccagtgaagtcctttctctcctctttcccacagaatttagcatggctcagacagtcactcagtctcaaccagagatgtctgtgcaggaggcagagaccgtgaccctgagctgcacatatgacaccagtgagagtgattattatttattctggtacaagcagcctcccagcaggcagatgattctcgttattcgccaagaagcttataagcaacagaatgcaacagagaatcgtttctctgtgaacttccagaaagcagccaaatccttcagtctcaagatctcagactcacagctgggggatgccgcgatgtatttctgtgcttataggagcgcacagtgagacaagcaacagggagaggcttacagaaacctcagacctcagcatctgtgcaaaggtcagggggaagtgttcagggttataggaacataaagaggaaataattgtcttccctaaagaaaaaaaaatgtatctgactataggaaacacagaggggatgtctataagctgtaatttttgaaatagtaataaaataatgaatccacacatgccttatagattttcaaagtaccttcacatgttaatccattaaacctgcataagcctgtgtgttacataggtcagatcagatattctaaggatcactgctatccagagaatcttagagcttgacctaaagctatattcttttagaattatatatttttgctttattattttaattactatctatctgtacatcccatgatcatatcaaagtcaatatatccaaaactgaatttcttaccatctccacaaacctttattttttcttcatttttttctcctcagccttgctcaagattcaggaacacaataaaagtttgctattgctgggtttccagtttggggaatttcttcaccctcgactttccagcctgggctatcagatttttatgcataccttattacattctaattataaaatggtgcaaaaaaaaacactacatcatgtcagtctcactgtttcccctctatccgtcattctttctgactttaacctggcttaatcctgtatttcttaacgttctttaaagcatcatttgtcttgacataagaaagtaaggaaagaaagcaaacgactgtcaagtaggatttcatgtactgctagtactcaccagcaaacgctaaaaaaaaaaaaaaaagaggaagttaacttctggtaatgctataattgcttctggtaaggcaacctagcaggtggtgacaattttgataaacctggtccaacagggagaccaagcagctgccatggtccaagtctccacccctatgtcttctgagaattgggagatgcctggaccgtgagaggattctcccttatgctaagggaaaaattaaaataaatgaaaaaaataatgccaacatttctttttatgcccacaattcccccaatacatctccttcactattaagccccttgtggagcattttattccatctgctcactgtgggtggcgagaggaagtttggaatgacaaacagccgaaataattaagtccaataagcaggctccagagcttaggctgggggtctgtttggaatgagtggtgagagtgactggatgtggaagagggtaaggggaggccaagaccaaactgcagaatcataattcagattgccgagtcatttcccaaacacagcagcttcagtaacgccacaccctagcccagcttagcacccaggcttctgcttgtctgaaaaagtggggtaggcaccaatcaaaatgaaaacctttctctcacacgaggaagacaccttcaggctattcaggttttgtcctcccttttacccctgaggcccatgagtcacccagacttagattcgggctagttaccaagtttcatatcaaagctcacttctttctatccttgcttctagtgctttcacgcagctcctctcatttgaattaataaataatcattaatctactctctctaccttcgattgtgtcctcttttaatatggtttagctgtgtccccactcatatctcaacttgaattgtatctcccagaattcccacatgttgtgggagggaaccagggggaggtaatggaaacatgggggctggtctttcccatgctattctcatgatagtgaattaagtctcacaagatctgataggtttattgtgggtttctgcttttgcttcttcctcatttttctcttgccgccgccatgtaagaaatgcctttcacctcccaccatgattctgaggcctccccagccatgtgtaactctaagtccaattaaacctctttttcttcccagtctcaggtatgtctttattggcagggtgaaaacagactaaaatacacccttcaaacattgcttcacatagctgtcccagtgagcatcctataataaaaatcagatcatgtacacacacctctgcctcaataaagcctcatttcccacagaaaggcccagtgattatttagaatataagtccatcaaagcggaggccaccactgtatctccagcacttaccatgcctaacagggtaaatggtcagggtcatctactgatggattaattagtctgtaccctgcttagcaactcagcctcatttgttgccatattcccatccccccaaactgtacacgcccatccgctcagcaaatgaaattgtttcctgcatctatgcctttgccagcattgtcccctcagcatggaatgcccatccccaattaaccacttgcctattatttgaaaggttcgcaaacctcccctcttctctgaatccttgtcctgacccttttgcactggtagaactgatcactttctcctttatctcctaactgaaaccctaagcatatttctaacgtggcaaatccaacaccttatggtgtttacaggtatttttcactgtctccccactaaaatgcaaactgttagttaccaaggacacagttttacccatttcaatagcaactgtgcctccaacaatctttaattcacagaaatgattcttaagttttttgaatgaaggtaattaattgatgggcattttcctcattaaacattatagagtaaaaatggataaattttctattttgttatctcctccatagttgtgttaactcagaattctgagctaactcataggactgtaaggcatgtcaaaaattaatagtaacaacagtatcatgctgataataaaaatattagtagtagctaacaattattgagtatatatatatatatatatatgcgccccatattctgagaggtgcatgacatgctttatttcatttagtagtcccaacaaatccatgctgtagctactattgatatcccagttttatatgaagaattaatataggttcaaagaggccaaaatgcctagaatcacacaatgtacgactccctgaccactggcctttttcccttcccaaagggtggcaaactgctatagcatctcagtcttattaatgtaatagacacatagaacataagaaagaaattcatgaaaacagtgctgcaccatacatgcacttgtagtcctcactttttctagagtagtaattgcaagatgagacttatttcaagtatccttattaatagaagttaaatgtaaaaataacactattaccattattgtttacataggaaatttttgcctttttaacattagtttataattatttgacctgggactatacaatattttaaacttcttcagtgcatttttcaatagcgtttaagtttaaaatgcagtctttggcaggggcattaataaatgtttcaaatgtcattttgtataactctttaaagaatacaagagtttagaagaaatttctaacctttccaagttatctgaatttccaagttatcataggaagatccttcctttgtaacttttaaaacttttttgtatatggttgggcgtttctatgaatgatgcttttcaattttttttgcttcagtgaaaaattatatattgtgaaagctttcccacataaacaagcagtttttctatagcatgagtttcccatggctacaagatattgtatttttgaaatacacctcattttacccaataacttgaggttttttttgttttttttttttgtttttttttttttcagatggagtctcactctgtcacccaggctggagcacagtggtgcaatctcagctcactgcaacctcccacagccaggttcaggtgattctccttcctcagcctcccaagtagcagggattacaggtgcgcaccaccatgcacagctaatttttgtatttttagtgggggtttcctcatgttggccaggctggtctcagactgctgacctcaagtgatccgcccacctcggcctcctaaagtgctgggtttgcaggcgtgagcctctgtgcccggcctaacttgagttattgatcgagtaaatcaatgaatacagtaagcatgataagtacattgtttccaaattggagctataataagtaaaactgtaattttaaaaagatacttgtacataaaatagtatgcaagtaagagagagcccagatcaaagtaaccgaagcaaaacaaaacaaaacaaaaatctgttggctaataaaactgaaaaatctgggttaactactttaggaaggactgaccaaatgctcaaataatgtcaccacagcgtgtctctatcgtttggctcttgtttatattggctttactctgaagaaagctcaggcccacatgatggcaaagatggccgccaggagcctcagacttgtgtcctactgtgttagtttcctcctgctgctgtaacaaattatcacaaacatggtggcttgaacaatattactttattatcctacagtttgggagctcataagtctcactgcactaacacaaaggtgttggcagggctgtgttccttctataggctctaggggagactgagtgaaatcctgagcatccctggcttctagaggctgctgcgtgccttggctcatggccctcttccatcttcaaaactagaaatcgcagcactgtgacctctaccaccattgtctcatctcctgtcaccctcatggccctcctgagccttgatccttgagattacattgagatcccccacatattccagaataatcttcccatcttaagattcttggtgaatcccattttctaaatcacattttcaaggacatttgccacataaagtaacatattcacaggttctgaggataggtggtggacattcctatagactgaatgtttgcgtcctctcaaaatttgtatgttgaagtcctaatccccaaggtcatggtattaagtggtaggacctctgaaaggtgattaggtcatgagggtggagttctcatgagtgagattagtgcttttataaaagaggccccagagagctgccttgctctttccaccgtgtgagagcacagcaagaaggtaccatctatgaaccaggaaatggccctcaccagacactgagtctgctgctatcttgatcttagatttcccagccttaattgtcagaaataaatgttggttgttaaagccacccagtctatggcatttggagtataactgccccagtggatgagagagacatctttggaaagctacttctctccttaccatacctgccaaattaacaactccagcagaagaaacaggcttcttttgtgatatttccagaaaatatcctggactgactttgcttagactgatttcttcagatttgggaaacaggcagaggtggttcctcaaggcaaagccaagatgctactagaagaggaatgaataaggatacgtaaaaataacagatgaccccaatgctattaatttatttcaaactcctttttgccatcagaaagcagtaataagctcacatatcaattccaataaaataattttttaaatcgcccaaacttacatttcaacatagcaagcaaaaagcaatgaataaaattgcttcaccaaaatatagaagctctgttgaccagaaattcagcatagacagttgttcaagataatttcaatgtgttcagcagataaagggacaaataaggactctttaagggcaaatttagctgagggatgtgttaaattgtatatttggcagactgaaactaaagaataaaaaaagagacagcttgatataactttctatgccaaacccaatgttatactctaaatctaaaactccagaaaaagtttgaaagcaacaaatatgaagtcaggaaaatcattctaaattaccaactatttaggtataatcttgagcattttagctgtagatgaaagtcctatttattcatatagattctcatatgctatgaataatagttcatttggatgtctctttaaatcaaggagggataaagacaggaaggaagaaagctggcaggcaataagagccaaagtaaagatattattttgattaaaatatactcattgttgaggtatccacaaatatttgagaacacattgaagaagtaagacaggtcagaaaatataagtatatgatcagcacttagtgaaaacagttaaagagaaagaaagagcaaaagaaaaattgcttaaagcaacatagatattcaaagataaggaattaaagctgagataaatgtgacagaaatggaaaggaaggaaaatgaagttatgaaacattggcaaaaatagctaaagaatgcagaataaaatgtcctagaaaacatttatcaaagggttatattttattagcattcagtagtcacaaggcaagaaatatgatagctataaataaatacatgagaatgtttaaggttttatgatgatcatggctttactgttcaatatatattaaataaaccacaagttatctataacacagttctgaataaaatttaggaaacgtagagtcaggtacctcaatatagaaaaatacagaaataattaaccataatgcagacaaagtgacacccagttgtagagagcattacaagcattgaaatattcagaatattatttgattaaaaaaaagctcatgtaaagataccctaagcaataccaaagatacacacacacaaacacacacacacacacacacacacgacacatacatgctatatataggaaggaagaaagcttctttattggggacacagtttacatattacctcttgtttctatgagatgctataagaaaaaatctcttaagatttactacatgggtaatatatttatatagtgtctgtgtgtatgtatagcaaactcttatatatatatatggatatcttacagtcttatagacttatatgagagtgacagtaaaagagagagagagagaggagtgtatacctatttcctctcaaaaaggccatattctggcaactcccttattccccattccctactatgcagtttgatctagccttagatttcccaggaggttctcttccagaaaagtgcctgtagctataaaataatcttcatcttggctgtttcaatgcaggattcctattgagccaataccttaccattttctttccttcgtggaactgtgctttgtcataatgcaataagttttctatgaagtatatcataaacaacagtcctacagaattcatcattggacataatatagcttctttattggggacacagtttacatattacctcatgttctatgagatgctataagaaaaatttctcttaagatttcctacatggataatttgtacctacacttgtagtttgtttttatcatatggatgaggtaattatcacaggactgattgttttccttctttacattgactgctaataagttcagagccaatgttagcttaactccaactatagaggctgattgcatatattttaattccaaatctaattcaaggtttatgttcctgcccttatttttttcttcttgatttttgtatttctttgctgttgtttttgtagatttttctgtgccttatacttttttcaaagataattaaaacagtgtgtgaattcagtggggtggatgaatgaatgaggcagagaaaaaggaaattgacatggtaggataacaaactcacataatatgtagatacatataaaaagacacacaaagaaaaaaatttctctaatatatctaatcttctttatgaatgatcccatctaccaaatagtcaagaaacttaaattttgtaaattgcaattaacaatgtctcattttattcaggtttaaagagttcctttcactttaaatattcagttcatttaagttcaattccatgttagggctgatgtaaattctttcttagatgactcagtctctttaggtgatatgtttggaattcaaccaccttacccttttctttccgtgatgaaatttaggtgataaggtgagacagttgagtgtcacctgaggcaaaaaaaaaaaaaaaaaaaaaataggcttaaatccatgcattgccttctggatcttttggtctgagcagctgagcagccaatctactctgttccctgtgtaggtacctagttatatatggattttcctacctggacttttgggattatgtgttgacaccactgctgaagccaattgtttcagccgcttgactccatctcaaagaccctcatcatgggcacttctttgtacttagcccaggactttgccaggccactagctctctcaattctctgcatctacttcctggacccctggggacttctgtattccctgcacctgtaaacagaccatggggattctagaaagtagcctctgactcatgtagccaagccttgatttttctccagcgccatcttcccacgacttaagtaagacttcccccagagacatgcagcctgcccctagaacactgtgagaggtgctctactacccagtactcttgtgctgttcccatacttatctaaatgcttctagcctttcctaacccaatcagtgtccgcccatagcagaccaggggaaagaccagagtcctgacacctaagttccttgttctgcctccatttttctttaccctctaggacccaaaaaactgacctccctctctgtcctgcacctttctgtcaaactgatgtaaaactctatgatcaagtccagctggtcttacatataatatggtaaagaatacaataaataattaagaaaaagtgttacacctgaaaaaaaccttacttttaaggcagttctcttgttaagtaatcaaagatccaaatttagatgtcagagctgaatattaatgctttctatttccattcctctcagaataatctaatctctccccactcaagacagatagattcctcagaagaatatagataaggttatgtatctgaaaatataaaggagaaaagaatattaatacatttcaaaaatataatctcaattacaagtagagggaggaaatattttatatcaccaagggcactcattggaaaatcaccatagatattttcaaagaaaataaaagacttccaaaatcaaaagaaattaagaaaatgaagaaaagacaagccacagactgggagaaaatatttgcaaaatgcatatgtattttttaagtggtatccaaaatgtgcaaagtactcttaaaactcaacaataagccaggcatggtggctcacgcctgtaatcctagcactttggtaggccaaggtaggcaaatcacctgagatcaggagtttgagaccagcctggccaacatggcgaaaccctgtctgtactaaaaatagaaaaattatccaggcatggtggcgggagcctgtaatcccagctacttgggaggctgaggcaggagaatcacttgaacctgggaggtggaggttgcagtgagccgagattgagccattgcactccagcctaggcaacagagcaagactccgtctcaaaaaataaataaataaaataaaataaaacaataagaacatttaaaacccaatgaaaaaaatgggcaaatatctgaacagacacctcagatctgaactatctgaactatctgaacagactataaacaaagtatatagatggtaaagaagcacatgaaaagatgcttaacatcaaatattactagggacttgcacattaaaacagtgaaatatcactacctgcctatcagaatgactaaaatccaaaacactgaaaccatcaaattttgtgagaatatggagcaacaggaacccttattcattgctggtaggaatgccactttggaagatagtttggcagttactcataaaactaaacattctcttaccatatgattcagcaatcatgctccttagttttaactcaagtgagttgaaaacttctgtccccataaaaatctgcatgaaaatgtttgaagtacctttatttataattgctaaatcttgaaatcaaccaagatgtccttcaacaggtgaatctatcgacaaagtatggtacatccatacaatgaaatattattcaatgataaaaagacatgaccaggccgggcgcagtggctcatgtctgtaatcccagcacttcaggaggccgaggcaggcagatcacctgcagtcaggagttcgagatcaccctgggcaatacggtgaaactctgtctctaccaaaaatacaaaattagctgggtgtggtggcacatgcctgtaatcctagctactcaggaggctgaggcaggagaatcgcttgaacgaggatgtggtgagccgagatcatgccattgcactccagcctgggcaacaagagtaaatctccatctcaccaaaaaaaaaaaaaaagacatgaccacaaaaagacgtggaggaactgtaactgtatattgctaagtgaaagaaaccaatctgaaaagactatatactgtatcattccaactatataacattctgaacaaaaacaaaactatggggagtgtacactgatcaaagtctaatgtaaattatgggctttagttaataacaatatattaatattggcttatcaattgtaacacaagtatgacattaatgtaagatgtcaataataggggaaatggggaggatgagggttgagggggtgtataagagctctgtatttccactcagtagtaatacatcccatgctagtcttaatcttaaaaaggaaaatatattctagttgctgtatttcacaatgctatgatcattccttgtcttacttagttcattaaagctgccataacaatcatagactaggtagcttacgaattacagaaatttattctcagagtctggaggctgggaagccccaggtgaagacaccaatggatttggtatctggtaaaggcccatttcctggctcataggtgacattttctcatcatgtcctcacatagcggaaggacaaggcagctctctggagcctcatttataaaggcaccaatctcattcatgagggctttgccctcatgacatagtcaccgcccaatggcaccacctcctaatatcatcactttggcaattaggtttcaacatatgaattccaagggggaagacaaacattaagattgcagcagtcctttcttctctatcaaatccttgcttatccatctagatcctcagcaaatacaacttagactatatagcccataatgatctactttgctaatcaactcacatacaacttcttgactctgccatatgggggactttttaaaacattgacttatatttctacttaatcgtgtacaggtttatatgtgtcaatattcagaactatgatttacacacatagaaacatataaattaaaccaccatcatcactcccaatcatacacacacatgttcatatacagcatccaataaagcatcctattcaaatttggtaataaataaatatttacttcttgaaagatcaactggctaaagaaaataatgtattccgattcatccactttcccaaaggagggttctacacaacaatcactagtgtgtgcctttggtcacacttttaagtaacagtaagcaatgaaaaaacaaatagaaaatgccaggctgctctcatttgcactcctgcttcatgtaaatgctttcaattattcatctagcaaaccacacacacattgcaaatgcctaaaatttccttttgccaattagaggtaaacgcagtccccaatttctatccatagaagaattaaagcaattctatttgcatccaatgtaaccaaaagttgcctttctcaaaagatacctatgtggcctcaataatccagacaaaaggctcactctctcagtgtggctgctgtacttcttgcctcttgtctgtataatctactgaaattaggtaccacagcactttctctccaacaaatccatggaaagtaggaaaacatgttgaactactccaggactcccaaattcaggttgaaattttctttcaacatagaagtagaaacttctggtgaaagatggtaatagctcagcaggaagtcagcacaaacctctaaaggcaaagcaggaggccggagtcctcccctctctccctccctcataaggagccctgctctggagacttccatggggacaagagagaagaaatcgttttgctgctcagatcctaggattgagtgacataggaatggagggcccaaaaatttgagtaaaattcctagacttggtttctgaaactatcctgactctaagattaagcaacttctcttcttaaatttcttcttataaatctctccttggggaacgttcctgggtggataaaacctatggaagaggggaaacagagttgtggagattaaagttaaaataaaaaaaagtctttttgttttgttttgtttaatcctattttctcattatttatctgaggtaatcaagatccagagaagtccctcccttgccctacatgggatagcagggggttccgcaaggattctgtcctcgcactgactcccactcccagtctgtgtctgcttttcataccaaacactaaatatgttattaaacaggagaataaaagttgtgaatatcaccctggcctagacagaaacacacaatatatacaataccatactataacagatattctactagatatgagagagccaatacaggctaatgaagaaacaagaggaaaagatgaaaaaaatgacatctagaggtattcgtaaaataaaaatctaataggtaagtaggcatgagttaatctgatctttcctctaccccaaattatttttctgccccaccgtctaggctagaatgtctacttcctgcttctgtgcctatagtcatcttagtctttgtctaagaacttggtcaaaccagaacctttaggtattgtgactccatcagttaatccctatggatattttgcttcttagtaacattctgggataacatttgtagactgctttggttattaacaaaaccaacaacatggagctttaatgcactctctaacttgagttctttgtcttgtctcttttacagctgcgttttctctgtgacaccaggaatcagcatttccattcaaatacagcaaactttaaaccgctttttgacaggaggaaacactttctgcctaatgaaggggatgaagcaggtaacccagagagtatctgccacacaggcctcctctacagtagctcagaattgcactgtttgattatttcttacacgtggcatctgcaaattcagaaaggtgagtgatgtcagatctaaaggtcccttcttccatcttggttcattcaaattcaggtctaagaggaaacattgaagaagctatctgaatttcaacaggactgattactttccaccaaaggctgtaggagacacagatttaaagagtgactagggggttaaacataaacatatattgacagtaattcctgcattgtcatcaaagtgtgctcatgtttgtaggccaactcttagtggtattcagacattggaaaactgtaaaaccttcatgcatttttaagatgacttctaaaatattttattattagtttaaatgtttaaatagctacaaaggttgtaaattccactgtaatataaacattgacattttcaaataaaactcagaatagcttttaaacatatccagtgaaaccttaataccaaagtgatttgatacccatcaacacccagttaaaattcacaacaagctcttcattgacaattgaagaccttatattgctcttttctttccttggaatcatatttccattcaacttctcctgcagaacttaattttagtatatttttgtttaaaggcttttgttgatcacccaaaatgcctgcaacaaaatcacgtaaaaaattgaaattgcttttaaattttctctgaccatactgctctaattgctaaaaattatctttctagattgagttataaatataattattgttgatgtaccttttattaaaacaacaaaaatatatttcaattttagttttaaacttacaggcgaaaattttttggaaatgcatttcttaagaaaatcactggggtcggcccggcgcagtggctcatgcctgtaatcccagcactttgggaggccaaggcgggtggatcacgaggtcgggcgattgagaccatcctggctaacacggtgaaaccccgtctctactaaaaatacaaaaaattagtcgagcgtggttgcacgcgcctgtattcccagctactcgggaagctgaggcaggagaacggcgtgaacctgggaggcggagcttgcagtgagccatgatcgcgccactgcactctggcctgggcgacagagcgagacactgtctcaaaaaaaaaaaaaaaaaagaaagtgactggggtcatatttacggttaattaaaggaggcttccttgacaccaataaattgtccctttgtttaatgttccaggggtgtttaaactgcagggcaatgctgcaaaaggagattccgtcttgaataaggttggggaagagcaattatgaaatttgagacgggaaacaagaaccacagtcaagctcttgaacagatcacttttaggaaaggttacatacagaagttgaagatctggaaattgattcccttaaaatacataactgttgcctagtttgaaaaatcactgcattagattgctctccacattactgatttcattctcagccagacttcatgaagtggtgaggtttgaggaaaatcagcaagagattttaatgacagagccttgagtttcagtaaacctgataaatttcctaaaacttatttgacatttctggcttgaaagaatagctcctgatgaattagaaaattatgggagattgagttcttgcatgacacaaagtcatttaaacatatatctttatcttgggaaagacagtttaaatgtcatggccatttattaataatattgtgaaaaaaagttatcccaatcctggaaaaaagaaaaatgatgattgctagtctttttttttctctatctgcaagagcattttcaagtaagcaattatctggcattcttggggatcgtaactttgttgtcagagcatatttacctagcaatccataactgagaaaaggctcacatagtttacattcctgtgggttggaggttaacctacagaaatggaagagttttgcgttcatagcctggaaaaaaaaattaaccccagattatcgtgtcaaccctaatagcattttattttgctatctatatagttgtatctttttcctgtaaacatttgtggaattagctttttttagttaatgattaagaatagtaacaaaatgtgaacccaggctcactccctatttgtattagtattttgttttttagcacatttaaggccatcctggcactaaatcagaaaactacttcctgatacctaaactataaaatcctggtttcatatacatctgaattaggcaaaaacatagctggctattatttatttaatttgatgtcttaacatgtaaagattttcttttcagaagaaatctaatggaccagatgtcctgaaacactcttaattatttttcagtagtacgaacatagccatgaaggcaaaggaaggtagatgatcaattcatgttaagagtttcaaattccatggactaatttatatctttctccacagccacctggcacattctgcctttgaacagatgctttacaaaaacataatctgtggacatggagatcttgcataaagcaaattctctctgatccacagcttcactgaggggtttcagttttctaggccagagtgactgctggagatgaagagattctatcaaacgtcagtgtaaaattgtctcttacttaaaatgccctcattgatcttatcctgatacccttactacagaagtttatcatgactcatctaggagataccagagagttcactagccaattcaagagcatgacttctcaaaattctccatgttttcctctttccttcctagctaatcccactttctcctgcctttgaaggctatagcttctctgccaatttcttgaattatggggttcctaagccctcttctatgttatccacagattctaggcaatcttactggctcctgagcctcgaataccatttaactgctctagactgacaaacctgtatctctagccaagactctccttggcacagacacactattgggctccctatctcatcaccccataggtccaccttctctgtgtccccatcctagtaaacgaagccatcagtgcctccaacatgttctcttcagtctagccagagttattatttaaaaatacaagtgcaatctgtttgctctcttgcttaaaactaatcagtgacttccagtttcccaaaggatggaatcccaaatcattactaaggctcacaaagcctttctttctctagcttattgctctggtttcatctttcatctttattcttcacccatcttgcactctgtgcttaatatctcctgtttgcttccaggtcctctctccatccttccacaccctgctttgtgccccaggtgactgacctatagggattataccaataagctatcttgtcttttggtttccagtaggtttttgcccaagggcagtacccacagagaacagaaaaaatgaggaaagtaaggtcaggctatatattcccccaacttcctcccttcccacatactgacattaacccacaatcagctccttacggtggcctctccaaatagcctgtctttctccaggttttggtaatcactccctcctttccattcaaggcctggagtgatgctagtcccaggttgtagcactatctcttatatgttccctgctcactgcttgtatttttataactagtgtcatgtttctcaaattacacaatttcagtatgccataagtttcctaccagaacccagattgatactgtctgctttcaaatcctaaaaggtgtcaactatggcttaaatgttccttatttcgggaggccttttctagccgtcttgacttggatgtaaccgcctgctaaacctcctacagcaccctgtccatctcctgacagaacatccttcacacttagcagcaatcattgaatgagtattagtgtcgccttctctaaacaacaaacaaactgtgtcagaaaaatataaagcaaaatttgtaggaaatataaaaataacttgataacatattcattatgggacaccttaatatctttttctcagagagagaaagagagagaggatgatggaaaaaactttatattaaacatatagctacagaatatttacaaaaaaatgagcatataatatgactcaaaaaatgggaatcatataagccacattgtctgaacctaatgcaataaagctagaaactaataattaaaagatagcaaataaatgagtagaaagagaaccacttataatattctaaaacattttcaggtcaaagaactaagagttaaaattacacgtcactaaaaatgaaccctaataatggtactacataaaaaaactatatatttgttcaaagcaatattcacaagaaaatgcatccatctattaataaaaagtaaaacaaaggagccaaatctggcaattcaagaaataaaaaagaaatgagcaaaataagccaaaacagagaaggggaaagtttaatgataaaagcaggaattaatttaaatgcaaagcaataattagaatgtacaaataaaggcaatatttctaggaaaactgataataaaaaagaaaacacaaatgtgcaatgttaagaacgcgaaaggtgctataaccccacaaaaaaaagcaatttttcaaatcactggttaatgccttgtatacatagatcttgatgaaattggtggtgtttagaaatatataactttttaatttaaacttctctactttctaaaaatttatactattttacaattccaaagtcaacatcaaattgtaaagaaaaaaatcctgaattctgcctcttcttccttcttcacatacgcagcaaataaatgctacacatataccaactactatgtctcgactctcctatgttttcatcattaaagaaaaaaacatattgcattcctactatatgccaatcattgcactacacactgggaaatcaaaaatgactatgagaaattccctgctttcaaggagttcatagtctagtgcgagaaacagacagatgtgcacactgattataatactatgtggtacctgtgataatgcataataatgatagatgtctttactgagtttctgctaagtgtcaaacaccttccattcagctgagatcttgtcctttcctccaactcttacccgggcattttcacataatagctcgttatcatctcaatttcaaaacactttttgtactcagatgcttctccaatttcccagtttctgtaaatggcaccacaacatttccttattcaggcttgaaccttttgagtttatagtcaggtaccaatgcttgtcagtttttcctttgaagtgctattgaatgtatattttgtttagaattcccatgactaccaccttattcaagtccttagattgttcccaccaagttgaaaggggtgtcctccttcctcttcattattgaagtctctttcttgctcttctcccctatcctaccagctcccaaccaccctctgaccctctgcaccactgccacacctttctttttaagatatcttttcatcatatccctccactattcacaatcttacaacagtttctattttctcatgaatataagccctttgaagtagctttcagtgacttccattatctcctcctcatttcaccaatttatcctcattcccagacactattacccagactctgttttctctgttagctggaccattcttcacactttctcaaagacatgtcatcctcactcctacctctctatatttcctgaaatagcctttagtgcgtgctctctctctctctatctaaacattatgtgttttttaggccttagctcctccaaagagattgtactaaattcccatagcctttcataatttccctctcttttgacctcacgtacagcatacacaaaaaaaatgcacccaatgctatgctactgtacaaagcagtgtactgctttgcactgttaactttaactctatgtgcattattttaatctttctaactatcttacaactccattaaaaccaagactagatactgtggaattatttaatacccccacccacctcatcatttatcacattacttgatacttggtgagtacttgctgggtacatttgaatgtaatgtcttttatttcttaatgtctttcattttctcaagtgttgttaaaggcaaaaagcaatgttggatggttttatcagttatgcagagttcatgcaggaaaagagatttcagtgggaccttgcttaagacaatagagaatttagtttaggatttaacaggtctagaaattaatgtagaaagctgtcccacaaagatctattatccagaatatgtaaggaacctaaacaattgaacaagcaaaaaacaaataactccatttaaaaatgggcaaaagacctgaacagacatttctcaaaagaatacacgcaagcggccaaccaacatatgaaaaaatgctccacatcactaatcaacagagaactgcaaatcaaaaccacgatgagatatcatctcacaccagtcagaatggctactattaaaaagtcaaaaaacaacagatgctttcaaggctgtggaaagaagggaaaacttacacactgttgatgggaaggtaaattagttcagccactgtgaaaagtagtttggagatctcgcaaagaacttaaaacacaactactattcaacccagcaatcccattatggggtagatatccaaaagaaatcaaatagttctacccccaaaagacacatatactcccatgtttattgcagcactatctacaatagcaaagaaatggaatcaacttaggtgcccagcgatggtgaattggattttaaaaatgtggtacatgtacaccatgtcatactatgtagtcataaaaaagaacaaaaccatgtcctttgcagcagagtgaatgcagctggaggccattatcctaagcaaattaatgcagggacagaaaaacaaataccctgtgttctcacttagaagtgggagctaaatattgggtaaacatggtcataaacatggcaacaatagaaactggggacaactagaggaagaaggaagggagtggagcaagggctgagaaactaactttcaggcgctatggtcgctgtattagtcccttttcatgctgctgataaaaacatgccaagactgggtaatttataaagaaaaagaggtttagtagactaacagttccaagtggctgggaaggcttcacaatcatggcagaaggcaaaagacacatcttaaatggtggcaggcaagagagaaatgagagccaagggaaagtggaagcctcttataaaaccatcaaatctcataagacttattcactaccaggagaacagtatgggggaagctgcccctatgattcaattatctcttactgggtctctcccacaacacatgggaattataggagctacaattcaagatatttgggtggggacacagccaaaccatatcactcactatctgggtgatgggatcatttgtgccccaattgtcagcatcatgcaatatacccagataacaaacctgcacttttttaccccctgaatctaaaataaaagttgaagggaaaaaaagaaagctgttccacattgattgcagtgagtataatgggcaaaaattactgcccccaacccgcagcccccaaatcctaacagaaatctgttacatacacacagacaagcatggattgagcattagctcagtagacaggtcggttgaatcccactttccagctgcatgatcataaacttattgtttaacctctgtaagcctgtttattcttctgtaaaatatagatcttgtgagaattaaatgagattatgcattcacttagcatagtgcctggcatacagtacagctcaatacatgttagttattattatcatcttttgtcctttcttccacaactttgtataagaagtgttggaggaactgaagaaaatgtgatgtgttcaacatggtacagaaaaggtacaccatgggcagatggtcaaggtgagtcatagactaacccagttcacaggagtagctactcatgttagaggagtcctaaagaaataaaagccttccttccctcccactctccctccatcaatggtccacagagttgagagaacacaactgtggtaggcatctaccattttgttcacttagaatggcaactcattcctggtaaaatataaattctaaccatgtgttatgaatggagactgctatcttacttatgaatgggctgatgaatccacccagaggtggatgcctgacccagctgaaccaatcatgttatgtatacaccactctagtcacaaattgcccccctggatgggaacctggctcagactgaagcaatcaaagccttacctcaatatttttaaatctgggatcagaaaggatcctcagtatttctttggtggctacactgtgagatgaatcccaaccaaaaaatgtttacaatcatgcctcctgctttgtggtggaatctggtctgaggaatgaaactaagacacgaatgaaaggaaaagtcttaaaggattaagttccctggcaccctggatgcctgaagtccagatacacttctgctcttgccaaggttattggagtcagtgcatttctcttcttgcctaagcacatttgagttacatttctgtcacttgtaacatcaatgagacgttaaagagttaattcactaggaaatttttaggaacaccttgctggcttacaagaagcatcaattctacgaattactttctcaggaatttctctaaatatcctgaagagggcactgtttccattcataacttctgtccaaacccacccccattcttttgtttttttttaatttttctttttatttcttttttttctttttcttttttttttatgaaagggagggactgagtaaattgcaggatgtgattctaattggttggaacatcttttgaaatcgtgtttctgtagagaaagaaaaactaccatatttggatagccctggccaactttcaaggctcctaaatctgagttttcagtgaactggacagaaaaaaaaaatgaagaagctactagcaatgattctgtggcttcaactagaccgtgagctgggggttcattgaaaagggagccatgggaggaaaggaattgtccatacaatgtttgggggtagagacaaggttcaatgcgactcatttgggttccctcgggaggaacaggattattggggtaaccagtgaatgcttccttctgaaatgttctctttggacagggttaagtggagagctgaaagtggaacaaaaccctctgttcctgagcatgcaggagggaaaaaactataccatctactgcaattattcaaccacttcagacagactgtattggtacaggcaggatcctgggaaaagtctggaatctctgtttgtgttgctatcaaatggagcagtgaagcaggagggacgattaatggcctcacttgataccaaagcccgtctcagcaccctccacatcacagctgccgtgcatgacctctctgccacctacttctgtgccgtggacacacagtgctcccctgacgccaccagtctgtacccaaacctgcagctggtgggcccactcctcctgcaggaactatgactgtgaggcttcgttcactgtctgtgcatttctttctgcaaggaaaattctgagatgggtgaaaaaagatgctgttttatcttcttaactgtggaatattttttaaaaggaaaatgtattcaggctgagggaagattcctaaccatgtatttcctgagaatatgaggtctcattctttactgcctcacagtcagaatttgttagtcttccattatggaataattttacatgtagtgcaactgtcacaaataattcctatgaaatatggaatcattatttgttttatatatgaatgtaacatatggcatttaccaatgaaagaaagaataaatgctttataaaagaatggtctatgtgaggttccttacctagtgtttcctgctaaaatactgactacagtagtcagataatatccgtgtgatctaagtacctgtttatctcaatgtgtggagagtctctgggaaatgtatcctttggctggatttactcgaaaactatctgagggtccttgccaaccagaagaatattatattttttcttgtattatttgccagtttcctcttctcctccctccatttttttttgtaattgttttgctacatggtagaatttatattaaactttatttgcccattgcagactagataaaatgaatttcactttcaggaaaattgtcttataagaaatccccaatttgaatgttatacaaaaataattgaaaataagttttcctgtcccactaatgagataatcagtaccttcagatatcaattgcatcatattttcatcccagacttctaggaaaataataaacttgattcagtcaggcttttaagtgacaatatttcagaaattaccattacaatgtaaaagctgaccttaacatttcaacatttgtaccttcctaagcaacagcacctttaaaaacatttaaaaactaaaaacacttatttctctaaattgcccctagagtctttacaagcgaatcagcttctgcagcaatttgttggcagattatgaaaagtcagccacagcagtgtacagaccaaaagctcctgctaccactcagagcctccagcagggactataataacttccgtatttagataaaataaaatttgacatgaaaaaccgactagttccatcatcctttgagtcaagcagaggtttcactctgacagagtaggctgaaaaaactttgaccttgtatttataaatactcacaacgtatcttaaatttcaagtttcttgatctgttaccaaagcaagtttccttgtcaatgactgattgtcgggaaatttttattttgcattgatgatcttatttgttgtgttgttacataatcagaaaacaggatgttacatcagattttctatatcctttctggagcatttaacagcatgtcttcacacactcatttccatgctgaaaacattttcaccaggaaactattcatgacggggaaaaaaatattgttcaatccaatctaattaactgaaggaacaatattgacttaagtccccaaatctcttccttcttagagagaactcttggattctgaagatgaacttttatatcttcttcagatcaagaatataaacaaaccctaaaacaaatgaatagaactgaggatttcattaatttgatctttagaacataaaaaactaagttctttccacttctccttcccaattttcctgactccttcccaacttatgagtatatagattttttgctttcttttcctagaatcacttactgtcactgaaaatatatcattaaaccttattctcgaagaaacaatacagacattcaaaattgaaccagttgactttaagggtgtgatggtgtagtaagaaaatactatcgaaggtgacaatctccaatacattagagcatgctaagccaaatatgttttcccccagtaggacctttaggaatgtctcaggtgactccaagcttccggcacttgctgtccatgaccagagcttctactaacaagaagttccataaaatacttggatccatcctaatcagatacaccagttgccaagtccacttaccacagagattaggaaaggagacatttttctcagttgtgctattcatgtcccagaaatggcatttaagacaaataattctttgagtatttcttccaccctgtctcatctgttttgatgtgaactagtctcttttttcattgcttttaacacagctggttattttttcttttaatagtgtgtctgcttcaaggtttatctagaagttgtttcttaatatcaaaaaagttaacattttttatttttactgaattatgaaatctaagtgtaaatatgaggtgcaccttctaggaatttatctaagactcagtatgcatgttcttccatctctcccagctacctggcctcccatcccctttcctgctggacttgttgatcctcggagactcaagtacatccttcacttagtctatgcactatataccttcttcaatgaggtccctgtgtcagggacatggttctcagtttccagctactttccatgagctccctcaagcaagcaaatatttttagaaggtatttttagaagacaacattttaaaagaccatagtgtcctttctactctactgtgtctgcaatatgttgcagtagaacatttcacaaagctagatcttctcagagctccagatgggaaccaggcaaaaagctctctttgcagcggacagtcaacctatcttgtggtttccattgtccgcattcctagctcagggttttagataggatttgtgattttttaaaactgccctgaaacctcaggctctgctcttgacatataaattatcaaaaagaaaaattaccaagtacctgtctcttgcaactcaaaaaaatgccttatttcaggatattttttcctcctaagactttttaagtccattttgaatacaaaatcaataatttgaccctttgatctcactggatcctttcacaatctccctttactggagcaataagattcatcctcaaaatttgtggcaagagatttacaggggaaaaaatgaattttaaagaaggaaattatcatatttgaaactgttagtccactccatttagactcagagattctaataacacaacagtgtgaacaccagatttggttatcagaaagaattcctgagtattcaaactcttctactgtgagctctatgcccttaggcaagtttcataatgtatttaagcctcacttttctcatcaaaaaaatatggaaaaaataataaccactttctaaagtttttatgacatttaaaatgagatggtgtatatgtaaagtaaacagcacacacaccagatcttctagaacagtgtttactagagaaaattcataaagacaagagaaagagcaggtgtgtggtttccccagaggcagcactcaccctacattctgaaacagcacacagcaacctagcatggccaatgtgagaccctaagaaagagaacccagtcttgagccatggaactttaaggctgcactggggaagcaccaggccttactgtagcatgggggctgggctccaaattatgtgattatagcaaaatcaaggaaatctgcaacctccagtcctgatctgccacctcagctctcttacaaaatttattgcctcaagtgctaggctggggctctattagaaccagttccttctctggaaggccaccctgcagggaatccattacccttacctctcagtatgtgaaattcactagcacagagcctggcatgtagttggtataaatgtggaatgaatgtgtgcagccatggaggacaatgtcttcagtccctttgtaatgcagaaagtgtgcttgttctcagatcaaataattaacttattgaacaagtgtttataggtatctactaggtaccaggctgtcttctagacacttgaactatcttcttttaaaaaatgcacgaagatatcagattttatagaaaatacattctagtaagcattaaccataagtaaattactatatggtttatgacttcagagagtctctttagcgttaatatattttgcattacaatatatgagaagataagtcggacgggcgcggtagttcacgcctgtcatcccagcactttgggaggccaaggcgggtggatcacaaggtcaggagatcgagaccatcatggctaacacggtgaaaccccgtctctactaaaaatatatatatatatatataaaattagccgggcgcggtggtgggcgcctatagtcccagctactcgggaggctaaggcaggagaatggtgtgaacccgggaggcggaggttgcagtgagccaagatcgtgccaccacactccagcttgggtgacagagagagactccgtctcaaaaaaaaaaaaaagaagataagtctatggagacaagaatcagagcaagttaggggatagggaattctggagggggccacagaagggtggttcccttgtaattttaggtaaagtgtcagagtagcctcactggaaggataacatttgagcaaaattgaagaagatgagagagtgaatcttgcatatacttggagcaagttttccaagtagaggagagtccggtcctaaattaggaaatgcctacatgttctagaactaggtggaatgagaagccataggaaggctttgagaaaggagtgataaaatctgacttccatgtaaaagtcttactctggctgccgtgctgagaatagactgcagatcatcaagatgaaagtggggaaaattgttgtattaacattaaaaccaaagatatctggtgttactctgagctcagaggcttcttccaccagaaaagctcattcaagagcagctgttgttactgctcctgctgatggaagaggggctaaagacatatttgatagcctttctgtagatctcttgactgcagatgacctgtgagtttaggggaaaatgacaggaaggagtcttaatttcagacacaagaaggtctgttgtgaaggcatcttccaaaaggcaatatttgtgctttcttctgttgtgtaagactccctactcaaatttaggcagtttaaggaccttagaaaattgtgctgtggtgataaaggtaatggaagtcagagcagagggataataaaaatccatatgcctctttgaaagcctgtgtaataaagatatctgctgcctcaccgatctgaacagggttgaataagcaacaaatggacaagaatgctcagtccctgagctaccaggagacataggcctttagtgggactgcctatataatttacgggacccagtacaaaatgaaaatgcataacttcctaagaatttgaagactgcaacagcagagcattaaagcatgagttctatgagactgtacaggtttcatacccaggaagctggccctgatcactactagtttggaatgccatcattattcagatatcgatgttacaggcaggagcatgggaaagaccttaaattaatttgataacaattcaacctagtggcatacagaatgagggcaaactaactgagtagtttggtgtagaaaagaagcacctcacctcctcaaattacctctgagatggtgagatgccctgtccttttgacatctacatatttaatataaactcttcacctaggaccacagcagtggcagagatccagatgctcggagagatctatttgcacaagaaaaaatatgcataaagaggttaatagtcaaaccaaataaggggctgagttgtaccgtgagcttttttacaacttcaaagtgggaaacatttattgcccttactcatggtgctgtctaaagaataactttttactctcctgaacatttcagggttctactcttattagagaaattgtactattatcattttatttttaaaatatttttagaaatgggggtctcactgtgttggtcaaactcttgagctccagccatcctcctgcctcagcctccaggggagctgggactccaggtacgcaccaccccacccggccactgagtcactattaaaaatcatttagcatagcccggcctggtgtggtggctcacgcctgtaatcccagcactttgggaggctgaggtgggtggatcacctgaggtcaggagttcaagaccagcctgaccaatatggtgaaaccccgtctctacttaaaaaaaaaaaaattagcctggcatggtggcacccgcctgaaatcccagctactcaggaggctagggcaggagaatcacttgaacccaggaggcggaggttgcagtgagccaagatcacaccactgcactctagcctgggtgacagagtgagactccatctcagaaaaaaaaaaaaaaatcatttagcatacccagtctggggctttctactgagagcctttgttgacttctcttctaaggcaaagagcagggatataaagaagtaacacttcgaaagatggatgttctagttacatttctaggctctgaaatcaaatacttaatccacttattgactgattaatttatccaacaaatattaaacttgaccgacccttatagtgtctggagcctagtaaataactattgaataagctgtgaacagacagccaagtcctgcggactcagagaataatgagacaaatcagatattgaatcctggcttcaccacttttgagcagtgtgacctggagcaatttgtttatcctctctgatcatcaatttcctcatctataaaatgggaacaataatattaacacctattttcacaatcatgtggattaatgtatgcaaagcctctgtttcatcactaagcactcagtaaatattagctatcatcatcatcattactaatttctattgatttaactagacacagaaagggcagcatgtgtcttacaagccagcgcttccctcttctaaccactaattcaaaaaggattgtaagtaatgtttagaggtcactccctagcccaaaataggatgccactgtgttgtgctttgttttctttcttcctccagtgctgaagcacttgtgtgttttggttaatctaagatttaaaagattcctacatgtagtcatgcaaagtacttgtatatacctctaaggacctagcaggtctagtgatcctggagtctcatatccgaaagaggaaccagtactaaaagacaaacttcccaaaatctaaagaagggaagtgcaatcaatggtatgagttagaagcctcaatcctgggagagacagcctgtgcaagccaggagaaatcatgggttctccagtccccagcactggagcagccatgatcagtgcctccacttcaatgcttgtgaggctgttactctctggtgagcaaaatgacagtttaaaattttggctcttttataatttctcttatttctcattttgttacttagattcaatgtcgtttccattcattctaataagaaccttggctttccaggaagaaccactagagactcagtgaattagacacagggctatgtgaccctttcttcaggggcacacctgacgttgaactgtacctacagaatgggtaggtaccttcctcttgtggtatgtccaatatcccaaagagatatcaaaatgccttgtctctgaggcatcatgataaatgaaaaggaagatttcaggcccattaagttaagattaaaacctctttccacttgcagaaaacctctatccaagcactaggcacaattgtgtacttttatgttcctaatgacacagtaggggagactaacagaggagttgagtgcaaattgcaaggggtatgagaggggctgggtgtgagcagtttctttttcctatccagacagggccctggagtgcaggagtgtatgtgggaagttggacaggcttcgtgatttgctatcccaggttaagtagcacatgagactgcatcttagaaatggggaaaggaaagatttgtcaaaacattgcccatatctgtcctctaattatagctcactgatcaaaactacaagcctagtaatgtaacgaaggaaagttctttgacatcagttatttaaaatatgtacaatgtgattttctgaaatacctttgtatttaaaatgtaatttaaattacccttaaaattaaaataaatcaataactgttttagtccattttgtgctgctataatagaatacctgagaatgtgtaatttatgaagaacagagacttatttcttacagttttggaagatgggaaatccaaggtccaggggcctgcatctggggagggccttcttgctgcaccatactatggccaaaggcagagggcaaaagagtgcatgcaagagggagaaacggataaagtgccaaactcattcttttatcaggaacccactcccaagatatctaacccactcccatgataatgtcattaatctattcatgaggacagagccctcatgaccttttaaaggtcccacctctcaacactgttgcattggggattaaatttccaacatatgaactttggggggcacattcaaaccataacaataataaaacattaatattcctggggaaaatgagcaattcacaaaaagtagtacaaatggccactttataaagaggtatataaattctttagtcatcaaagaaacatttaaaaaagtgattcattttttccagctatcaaaatagtgaaggttactgacacacacacacacacacacacacacatatcatggaatttttttctgttactccaagaacctcctatggcaccatgagtcttgagccatttactatgtaaccagaaataaagactgcaaatactcaactgtaagccaagccacttctagtctaagtgcaagattgcatatttgaagagaaatatttccatttctgagaaaccagataaaattatgccaggactgaggaagaaaaaaagagaaaaaaaaaaagagcagtcaggaaaaaaaaagcagtcaaaaaaaaaaaaaaagaacaaagttaagtagactttgcaaaatgacttcaattgaattacaccatcattatcaaataaatcttcaagtccagataaaaaaggaataagtgtaccctcagcactacccttttctagaagagagaaccaaaaatatcttgattcactaccgttttcagtgaagaatattgcaaatgtgaaagatggtaataacaggagcaatcaaacaatagacagtcctgagaggttactgctcttttactgtaaagctaaactttgaaatgtgaatgctaagtctttgttaacacaattataataataattacattttagatagaatttcatatttattcttgcattgttgaagttaattctattttttgatattcagattcagctttagcttcccccagatattgactttaacatctcaccattcggcatttggtcacaatgtgtgttcagtggaccatgttttaaggaaataattagacgtatgaagagggtttatgtaagcatagatttatcacaatgttgtttgtaaaaactgaaaatattgaaacaactgtctaaaatactgacatgttgtgatgtctaagttctagtggaaattattctcccttagaataagtgttgtagcgataacagacttaggagtgtggtgagtcccctttgcacaaaaagaccacctcacacccaacatgactcttaagaatgaggacagtagtgaggacacactgcagaacactgagaggcagatgacgtcttataacctgttcattaacttgccacttgggggtgctattcaccagtgaaatcataatttatgcatgaattctgagtacaactgtgaatcctcacttcaacagtgatgccctctgctaggccagagacactaacaatgaactcctctctggactttctaattctgatcttaatgtttggtaagtacattttattaaaattttttgtattatttcaaaataataaatacttctccaaaagatacaacaactctggccaaacccataaaatcagtacttttttccccctacaggaggaaccagcagcaattcagtcaagcagacgggccaaataaccgtctcggagggagcatctgtgactatgaactgcacatacacatccacggggtaccctacccttttctggtatgtggaataccccagcaaacctctgcagcttcttcagagagagacaatggaaaacagcaaaaacttcggaggcggaaatattaaagacaaaaactcccccattgtgaaatattcagtccaggtatcagactcagccgtgtactactgtcttctgggagacactgtgttaaaagcacagtgggagctatacaaaaacctcaaaggctcagaggaagtatgtagtgaggctggaaaacccaggttgtagagccctgttctctctttcacagacagtcctgttaagacattattagaagataaggaaaatcaaaatcagatataactgcctctaattccagggggcacaggggtttctttgacagaaaatggggtcagggaagagggtctcagatgatatccctgctctcaattaggtcagttctctcttgtccttcaggctttcttgcatgatgtgtaggaattagaatatgatgacttggatgtcagtcctggctctactacttattagctatgcaaatttggccaagttaattgatgtctcagagctttagtttttttcacttgtgaagtagaaataaaaataatcacacaaatttagcatggagataaagtggaaaaaaggtaggttaggaaggggcagattagtactcaaagcatttctggaacttgcaagtcccaccgtagcagttctgctctctcacagcaatctctctgcctagtgctgaccatcctaacagggcttggcatgcccactgctttgtcacaccacaccacaccccacgccacgcccagccccaggccattatgatcaacatatcatcttttctctcacaggctcctactgacactacacacaaaaattaactcaaagtggatcatagacctaaatgtaaaaactaaaattgtaaaacccttagaagaaaacatagcagtaaattttcatgatcttgggttaagcactgatttcttagatgtgacaccaaaagcacaagcaataaaatagaacattgataagttggacttcaacaaaattaaacttgtttatgcttcaaaggacaccatcaagaaaatgaaatgataacccacagaatgggagaaaacatttgcaaatcatatgtactatgtacccgatgataagggacttgtatttagaatatataaggaacttttacaactcaataataaaaagaaatataactcaagcagtgagcaaaatatttaaatagacatttcttcaacaaagatacaagaatgtctaatatgcatatgaaaagttactcatgattagtcatgagacaaatgcaaatcaaaatcacaagatatcacttcgcaaaagtaaaaggctatgactttttaaaaaggacaataatgagtcttatcaaggatgtgagaaattagaaccctcatacattgttggtggggatgtaaaatgatgctatcactttggcaaacagtttggcagcacctcaaaatgtgaaacatagaattagcatatgacccagcaattccagcccgatgtatctacccacaatgcatatgtccccacaaaaacctgtgcatgaatgttcataacagcattgtttatggtagtcaaaagtgtaagtaatccaaatggacaaaccagatgtggtatctctatacaatggaatattattcagccataaaaaggaataaagtactgacacctactacaacatgaagaatcttgaaaacattatgctaagtggaaaaatccagacacaaaatggccatattgtgtatttcatttatatgaaataccaagaataggcaaatccaaagtcagaaagcagtgtggctgccagaagctgaaagaagtggggagtggggagggactacttaatagatgtgtggggtttcttttggggaaaatattctgaactagatagtggtgatggttgcgcaacattgtgaatacactaaaagctaccatattatatactctaaagtgattaaaagtatgaattttatgttgtgtgacttttacctcaataaaaaagaagacaaccaaaaaatctaaatgtgattcttaatgggacaagaagctctaaaaaaattaaattcttactattccattgcaaacaattccaataagtatgtgaaatatggagccatctgataaaacctatagcagtacgggaaggtatactaactcagcttttaactaaaaattatacaaatgttgactgacacaaaggcaaaggagaatagcaaagatggcatgagcctttaaggaaatcgttaaaaagtggaaaccttttaatgaatgcagttaaggcttaaagaaaatgtgaagtggaacataaaaagcgttttagaacagtttggagaaatgaagagggtggggtggggaggaaggttaatttacatatcgaggaaaacagaataattttggtagagaataaagaagaggtagggcacttcgacccctggtttcatcctctattcttcatcaaatacaataattttgggccgggcgcagtggctcatccctgtaatcctagcactttgagaggctgaggcaggcatatcacccgaggtcaggagttcgagaccagcctggccaacatggcaaaaaccccatctctactaaaaatacacaaattagctgggggtggcagtgggcacctgtaatcccagctactctggaggctgaggcaggagaattgcttgaacctgggaggcggaggttgcagtgagccaagatcatgccattgtactccagcctgggcaacaagagcaaaactccatctcaaaaaaaaaaaaaaaagaaaagaataattttcaaactggaaatgaagaaatgaaaaattatgacagataaaaagatactaagagagaacttagatgctttgaaaatgatcaattcttctgggtcttttaaactaatccccaacatacaaaaagaatttgcaggcatggttggcaaggcattgggagaattttttgaaaacctatcaggaatgaaggaaatccccaactcaggaacacagaaatagtggatcgatacccagcaaaattctagagcagattattaacagataatgtgtgggctcttagaaaataatgcagtgatcagtaccaagccagaatgagctcactaaagacatttttaaaacaagtcctaaattcaaaggacttccgtggacttcaaacgtgtcaaatatttgcaagatatttaataatttgtttttcactatatcaatgggaaaaatatatatatattatcatttgttgagtgttgtgtttatcacaggccctgttgtactacatatgtaataagaactaacatttatttatcaagggcttaatgtgcatgaagtgttgttctaaatgctttgcatacattaattcacttaatcttcactacaacctcatgaagtaggtgcaatccttattatagataaggaaactatctttaatacagaagaattaactaacttgcccaagaacacagagttagtaagggaagacctggcatacaaatacagtttgacaagcccaaagcctgcattcttaaattctatactttgttacctcccaatgttatctgtaatccccaccacaaaactataattttggtattgttacacccattttatgaataaggagactgaggattggagtattgaatagaaaaatccagtagaatctagtaagtagtaagactaaggctcaaacctaagttcatttggatctagactgtatcctctattcactttgtcattctgcgtaatgctagacttggtgaattctcagctgaaagaacggccatgtataaatatacaatttagaaaaatgtccctattgttacacctcatgattttatccttcactttgacctgttcacattgatcttatgtaaattcacacaaggtatgcccattaaatgtacaaatagcaaattttgagatcggtatatgatgatcatgtcctaatgatctccagctaatatgtttatttacagcataaattaaagattgaaaatcatctgaacaaactggaaagatagactgaaactgtcaaaatagaatttaatggagataactatatatttatacagtagttttataaaaatgagttgtaatgtctggaagaagggatcctgaatttttagtatttgttgtgtaacgcgctcatagtaattaaggaaaagattttctgaaaggatattagaaattctcataaaatcaatttgtgcaaaatacagctaggactcacagaaagaagaaaatcaccaattggctatgctttccgaatctacttttctctggatgtatgatctgttctcctcctgggaaaccagattccactgtaagcctgtcatattctactccacaataacttcagtttgaacatacccagctctgtttgctaagagatgagtctggtttgaatagcacagggctttaaagctctagttacactgtctaactgcggtttctgtacctctagttcaaattaatgagcgtagtatcttcccagatccaataagctattgccagaaaaaggaggttatttggtacaagcatgacctctatgtcatctctttagaaaggaatcccaaaagtggaaaaggactacatgctcaaaataattcaccaatgtgataaaacaactgaaactatcatagataacaataaaacaagtggaaaccagatgagtacagtaatactctgacagggcaacaatatttgaatcacatttgaagagacgtgaacaaactgtagcaagtctaaaaataagaaagataaaactaataaagtagtctgaaataataccatgtgcagaaagaaacaaggatgtcacataaagaaaccagagatatttataaggacacctttacaaaaaagaacagatctggccttgagttttcaaaagatataatgtgaaatgcagctactctacttgatctatcatagctggctgaagtctaacaatcaacaagcttctgttctcccacactaccctcacctttcttctaggactcctagtaggaggatgctaagtttggttctctatctgtattgtgggtgagaggggctgtttgtttgttttagagacagggtcttgctctgttgcccaggctagagtggagtaacatgatcatatctcactgtatcctcaaactcctgggctcaagtatttgacctgcataataaatgtctacgcctcatgccactaggtggcaatgtgggtgttatactgaaaagatcacagatggttcactttgcaagtaaaactgtaaatgttcttaagtgtgcatttctgctgcttctgatgggctgaaaatcccctttgatttctaaagtaaatgtagagacgttttaaaaataaaggactcctttgtccaagatatattccgaaatcctccaacagagacctgtgtgagcttctgctgcagtaataatggtgaagatccggcaatttttgttggctattttgtggcttcagctaagctgtaagttggggagtttcaggacatgagatatttttcaaaattctggggaggggagagaagggactccaagtggctaatctggaggccctcctgaaaatgtgtaaagaaatgtgtataaatattgcaataattgtaatattctgtatctgatgatgtctttgagaacaggtgtaagtgccgccaaaaatgaagtggagcagagtcctcagaacctgactgcccaggaaggagaatttatcacaatcaactgcagttactcggtaggaataagtgccttacactggctgcaacagcatccaggaggaggcattgtttccttgtttatgctgagctcagggaagaagaagcatggaagattaattgccacaataaacatacaggaaaagcacagctccctgcacatcacagcctcccatcccagagactctgccgtctacatctgtgctgtcagacacagtgctccccaggcacctggagcccgtacctaaactctaaagttgaggcatcatttcttactcctgtctttcagacttgtctgtctctatccttggtcagatgatgtaaaatgtttaagtttttaaaatataatattctccccttctagaccatctctcttctctacaacatcatcaccaattatgttaaccagacagtatgtgatttttatcttgaaagtaaaatatacagggtataaaaatcccgattctgctacttattaactggatgatcttgacaaagttacttaacttctctgtgcttcagttttccctcagctataaaaaggaaacagtgttagccatggtacgtaaccccaattgtggggattacatgaggtaatatacacaaagggcttgacacatttcctggcacgtagtgttacataaggggtatcaattattagtattagttttagatgtaccatgagtttgctaatattcactatggattaataccacagatcattggagaagtatgtggaatataaataataagcaccttataataattttagtttttagattctttcctaatgatgtccagcacttggcctttttaatagtgttaagaaaaacagggagtagctgtagaaaacgtaatagaaggatgactctatggtttggtttgtggtgtggaaatgaaagactggtaagagatgtttctgaggaagctcagctgcttctttggaaaaaaggacaggttctaagttttcatgtggagatctctaatggaaacttgcatttgtggaaattcatgaagcaaaatatcaaacccagtgtatctaaatcaacggttctgtatatcccccaaggattctttacattactattcccaatcccagtggaattcttatatcaaaacaagttttatgattataattgttcttattactcaacaacatcaatcacatatattaaattacagctacattcttttttaaaatcaaaggctttttaaatcaaaatactacctgcacatatctaaaaagccaatagtattataaaggtctgttccttccttagcccatcaagaaaacagaaataccatgctctacccccaccttccaattcaaatccattctagcaatttctaattaatatgtatatactcttgatttatcattattaagcattatctattgacttccttctatggcagcatgcaaatactctcactttctcaacatagttatatatatatcataagctggggttaaatagacagtcagtgcatatatgattatgaccacatgaatattgccactgtccaaccaaaatgacaactatgagtatatatcctttctggtacaacgtattttcttagttaataattacatttttttcatttattctatgtcaatgtgctattttttctaagttcttcaacacagtcttaaaaatatttattaataatttctctcaaatgcttcaagcaccttaatttcttttttttcccctcaagattccctttcctttgacctccattgtttctctgtgtgaactgattgctctataagcataaatgtgattctagacattttagtaccactctcccaagttggcattcttgcattttggatctcatatcttcatttcccaaagacaaatactagagagaaaaaagggagaggaagaagaaggagaaagagaaaggagaaagaaacactcttgggctcacttttgaacaatgagagaaacaaatgaataaatggttcctgccctcccccatgccctgcaggaggaaaagtctgcggcatattccaaaagactcttcagaaggtcatgccaggatcaggcaccagtcatgcacatggtggccagctccattatgcaccattgcattggctctctccactacccaaatttgctctcttgatccctcactcctgctccatgagatcagttcccaaaaatgccctgcatgcaaacctttatctcagtctcagcttttaagggaatgtaagctaagacatgccttttctccctgtgaatagagaggacacggagccagaagacacaaccctgcccgtctgctctcagtagtgcctcatccccttcaaaagccctagatactggcctatgcagctgtcccagggactactgaccacagcttctctatcggtgatacatgttcctggcttcctgtttttaagaagtactggacacacctgtgtcactttcctgaaagaaagagtgctgagattggagggtccaagtggaattacaggctgagacagagagaagatacaggagatgctggccctaacagagagggaaaacaaaacaaaacaaaacaagaaactattcttatgaaataaaataaaaagtctccccatctgagagtccactggtctttcctgaaagccaagtcatttttccatcgaataaatgcacgagtaaaaatcaagaaaacataaacatggataaaagtttcctcatagagttgacaagattattcacagagacagacttcttggtctcaattttctcagcatcctcagagtttactgtgtggacactatgatcacagaaagaatctcaggtgccaaagctagcaattcaagttgtttctggtggaagtcagtgccctcctgtagtcaaatgaatgaactagtagaaaccactgctttggtcagtttcccctctcctgtatctggccttcagcacctcagtagatgcttagagagcacttaccaggcaccagctcccagttgatatgggaaccattagaactctctccagagaaactcagtctggcccagtgtttctgacttcaagcctcatttccatgaatcaggtagctggtgaaattgatagactgcaaactccatgagggcaggaaccatgccttggtcattacagtgtccccagtacttagcatagtgcctggagccaggagcgttctcaatgatctacgctgctttgtcatctgctctgataatgagagtttcttgatgtcaagggctgtgttttgttcatttttgtatccacaaagggattagcactgtatttaacaatagtagaaactgaagaaaaaaaaattgtgtggaattacatttcctctttttcatcagaagtgacttagtcttgctgactttctttctatgcccttgtgtgttgcctctttgtttgcttacttgatttttttgcctcactgagaatgtaaggtctgtgaggacatcggcttgtgtttcttcatccctgatatttcttttgcaaccagcccaattctgatatctagaaggaggtcaagaagtggtttttggaagaataagtgaatgtaatagttatttcggacttgtgttaaaaggcctctttgcacgatttagcagaaaaagcactggagtcttagtcccggttttgcagctaactgggtaatgtaattctgaagtcacatccccactttcggcttcagtttataacctggaaaattaggataataatacacactctacctttatcaaaaaaaatcacgatctaatctgaattagatcatgaaaatgaataccttttaaaaagtgaaaaattttaaacaaacaaaaattaatattattaaggaattatatatatatatatggaattaaatggacaagaaatattatcctaatatactccaagacaatagttttcactcccatacttatccgcactgctatacaattcagtcagtgccaaatcactacccacacacctggttgtccttattactgtggctttgcaaccttcccatcactcagcttatctaaatattctcctgtatctaaaaccagtttttagaatctccaaagagcttgttttccaacatcccccagaaacatgcatttctcaccttactgagccaaactattccccagtgttcatcctctctccaagaaaagtttttattcatttggtcattggtcaacatttttctcagctgtctatttctcaaaatgtatgttctattctactattttcttaaactaatgctattttcaccactggccaaactttgtatttgaatttgaatcttatttgaattttacattctactttggccatatctttgtaatcagaaataccagtgatagtactcaccattcggtgtacaaagtatataaaatagacatgctccatatctattaagtgatgaaaattttctaggtgattttattataaaattaaacatttttagaagaaaatgcttctttagtagattgagaagaaaatattccagggaatgaccaacccagtgatgtcatcttactgtatatataaattttcatacttgattactactataatcaactacaatgtgaacatttcttttgaagtgctaatcggtatgaaatattctcttcaacctcagattaaatattcaccctcagtccccctcatttcccctgaaatacaatgacattaaattgcctgatctttgcattttctgatttattttatttttatttattttcctttgaggtgggctgggtacttgcaatggctaatagtgcagagctgcaattctaggcactatcagcaggtgttttaactaacacattatgtggattatttaaaaacttaatttaaggtatatgataatatagtactgctttgtatttttacaaactcatatttttttttttttttttttttttgagacggagtctcgctctgtcgcccaggctggagtgcagtggcgggatctcggctcactgcaagctccgcctcccgggttcacgccattctcctgcctcagcctcccaagtagttgggactacaggcgcccgccactacgcccggctaattttttgtatttttagtagagacggggtttcaccgttttagccgggatggtctcgatctcctgacctcgtgatctgcccgcctcggcctcccaaagtgctgggattacaggcgtgagccaccgcgcccggcctacaagctcatattttaaagctccattcttagctcagagctgagccattaaagttcaataatgtaagacagcaagaatgctaaagcttgatgctaaacctattcagtaatatggaacagcatttgagatcaggaaggaggtggtcccacaactgggaattaaaatcaaaatggatttgagcagataaagctgcatgtccaaaggaagttggtgggaaaacttgaatctgccaggaattttctgctagatttactgcagatcctgccagattcaagccaagcatagaaaaataagcagaaaacctccttcatcactgcctgtgaaagaatgttgagtccaagagacgagtagagaaagacctctatagattaggacccattaatatacactgacttggcaaaccgagacctagaggcaagtacagaccacaggaccaccagatgatttactaccttggatcctactggtggcaaaagctgctcccagggtccacttccctgtacagaaaactacctcatagaaactgaaaattatatggcaatatacatcaaagagtccttgcactctgaccctgtaatttcacttctagaaatttcttctttcttaaaaaaacaatcaagtatgtacaaagattcattttttaaatgttggtgagagctttatttaaatgagtggagaaggaaaagaaaccccaatgtctcacaaaggagttgatttaaaaactgggggcacattggatataaccaataaaaatcattttatctaaacttctgcttccagccacgccgaaataacagggaccagatttaccattccacttgaaacaacagcaactgagaaggctgcagacaaatgacataaatcaacaatttccaaaacacggtatactaagcaataaatgaccatgatcctgagagatgggaaacaaatgaggcgagccctaacattgcaatagcttattgccttgagagagtttctaggccacagcacaaagaggggaaactgaggcagaacctggtaggctccctgaattgaggcaacagatctgagacagagaagactaaggcagctgaagttcataagacagaatacacgagaggagagaggggcacagagaggacctagagatctgccgagggtgccctcaagtattcagcagaatgctcatctgcgcacgcatgtggaatctacccgagggtgggtggcggcagcagggaataaccattcaaaaagattaaaggaaagaggacctcttcaagtatgtctagaatttagaaaagagtttattgcttagccatatatttcttaattctttaattaatatttcatacatttcattttctctggctctagtcacttatcactgtggtccattttcaaacaaagaatcatttcacatattgaggaaacaatatatgaatagcctgtctggcttagataaagagtaaaggcaagagaccaggtgcggtggctcacgtctgtaattctggtcctttaggaggcagaggtgggcagattacctgaggtcaaaagtttgagaccagcttgaccaacatgatgaaaccctgtctctactaaaactacaaagaagtagttgggtgtggtggcacatgcctgtaattgcagctattccagaggctgaggcaggagaatcacttgatcatgggaggcggaagttgcagtgagtggagatcacgtcactgcactccagcctgagcaacagaacaagacttcgtctcaaaaaaaaaagtaaagacaagaataagtatcacccatatggcatgaccaaagtttttggtaaacctagggttttttttctgttgtcagtaataaaattgcccttaaaaactagtttttatttctcattcctgaactcatttacatataatgtcgaagtatgataaattcaaactatgctgacacctgtacgaatgtggcttagtatgatataaagtctttatactttcaccaacttcaaacctcagtttctactgttataaagttcatttcactctctcttgtgaccatttaaatactttcacatatttcatcgcatttttcatcttctagggctgaggactcctaattcttaagaatatttctgttatccctataattactgtcgtgtctctccaggcattcttttttagtgaacagttgtcattaatcacttccagaaaggattcaaacaccatctctacatttatccttccaagtgctgtgactattgccttgcgaactacattttccaggctcccttgcagctaaggtgcagatctgtattcagccaagtatttgattgggagatgagccatatgaggaacaggttaggcaggggcatcccttttcttggtttaggggcagtggaggccatgtggtctgggttaggcagcaacagcatcttcttgattgggccaggagcagtaacttcctgtttgggcccatttggctgcatattctgttgctggcagcactggaggcagctggcatagggataggactgcagccttcttatgaggctgatggatgggtggttctgggcatcactcctggaagtcgagcctagaatctttttctccagtctgcccaatgattctatgagccttctgcctccccaaatcctgatctgcttacactaggtaaagcgatttcctttctttcttgtcccttagcacacagatatctcacagtgtttagtctgagacccaccacagctttcattccagcatcctttaagctgagtatcagacctggttcactttttcactgcagtacacttggctcattccaatgaggatgacttcatgtttatagtgatttctggttcctttgcttggaaatcctaaaagatagaaaagagtctccagttgctgcagacgcaggcatgagatataccgaaaactctccaaaattgtctcttggaatgtttcttcattacttcactaggtttctttctaaccttcagagctagtaaggaccttggattaaaagggccattgaatttctagtttagttaagaaatattttcctcatttcatgggagtggggaagcagtgcagactaaactcagagcccacatcatgttgttcttaccagttcaaatcaaatcacggtttccagtcacttggctaatatttatccttctttaaatcttgatgaaatgtctcttcctcaatgaacacttctctgcccctcaacctaaatttgttcccctcgtgttactgttttaaagaaccctgtaatttctatgtatttctgtgtgattatttgtataatatctgtccttcctattaacctctaagttccactaaatgctctgtgttcagaatagtgcctggcacaaaggagtatgacaaatagtgatgagtgaatgaatctgagccatcagacatgtatcttactttgtgttgggctgtccctcaagtgtagatgttcctagtgacaatcccattaattcaaacactgactggagaggattgaaaacatatgaagcagtgcttttggaactgaggctgtagtccaatatgactggagataaaaaatgaagactttaaaaacagaattcacataaaagcaggtatcaacatggaaaactgcagaggatgcctgtatacacagtgggcacagcagcagcattagaccaatcacctccaaacttgaggttccaggctgaggtgacagatcagagtgaaccaggcactgtagaacaatgggaacacttagattcctgacactggaatttgctgattcttctactaacgtgtagcaagaaatttagccttacccaaagtcaggtctggtctttgtcccagttcctgggagataacctctgaaggctcggaatttcctgaattgttggcatgtctttataattgatggtggggtccttggaccgcacttaatagtttctgctatcaagatgactcattgtgaggctggccacaatcaatggtctcaggatgggggctggccatgccagaaagaccaaccatataacatagggtggagggtttgtgtcacaacctagagagtgagttcaaccacacaggctatcagtcatctgatataatgaagccccaataaaaactctggacaccaaagctcagctgagttttccagactggcaatattccatgggtattgtcacgccttgatgctgggagggtaactcatccctgaggacagtggaagtttcacgtttggaaccctaccagactctgccctatgcatctcatcccttggctgcttttaatgtatcctttctctgtaataaacgaatcacaagtatactaggtttcaatgagttctatgagtctttctagtgaattatggaacctgatttaggaaatacccaaccttgccattggtgccagtagtgagagtggtcttgcatgaacttatctcccctttgtagttgagtcctagcgacttacagttgggggcagaagtcttatgtagatttagtctggaggtctatgaccttaaccttgcagtttggctaactctgggtagctacattttgtattgagcaactctatatgaataaaagaagttttgttcatataatgccttaacagtgaatcaagtatatcaagaaagttttttaaaagttaaaagtaggcaagtctactggtaataaagtaggcaagtcacaaggtaattaaatgcctacgtttcaatgattacacatgttgcttagaacatacacatatatgagatcatcacgttaaaatatttctaacacacaggctggcaacacctaacaataataataattagtaattgtctagttcttactactaactggtttctgttctgagtgttctacatatattaactaatttaattctcataagaactctggttattagccaggtttgtagaagctgaggcacaaggaggttaaatacttcgccctatggcacactcccaaaatttgaatccaaaccatccaactccatagctcatgctcttaaccaatgccccatacagcttctcagaaggcaatcacttgaaatttctctctgatcttatagaaaggtgttagtagactggttatcttaacgtccaatcccaatcatctttgtagcaaagtaatatttttatatgaacatgtcagaggcatttgaaccagagcaactccatcttgaataggggctgggtaaaatgaggctgaggcctactgggctgcattcccaggaggctaatgcattcttggtcacaggatgagaaaggaggttgacacaagatacaggtaataaagaccttgctgataaaacaggttgcagtaaagaagcctgctaaaatccaccaaaaccaagatggcgacaagagtgacctctggtcatccttattgctacactcccaccagtgccacgacagtttacaaataccatggcaatgtcaggaagttaccctatctaaaaaggggaggcatgaataatctaccccttgtttagcatataatcaagaaataaccataaaaatgggcaatcagcagccctcaaggatgctctgtctatggagtagccatacttttattcctctagtttcttaataaactttctttcactttactatatggactcaccctgaattctttcttgcgtgagatccaagaaccctctcttagggtctggattgggacccctttccagcaacaaagagatgtgtattttatttctgaaaatacttttttgctttgttatcattctcatgttaggccagcagctcaggaagtcctggtctccttcctatattggaaaagggagttcacaatgaacacaaaagaagaaaggataaatttgaaaattcctctggagacaatagaatggaaaaaaggggttttgagtttgggttacgacttttgagtttaaaaataaatctatgcctcaaaaagttctcttagaatatatctgaatacaaaaaccaattatgcaaccctagatttaatgcaaatttcttagtttctgggaatttctggggtgatggagacaaaagcaagaaagtaagacatcagtgaagatctctgcccatctccacataccctcccagcagtggggtgggaggaggcaatttttagcccccaaataggatgttaggaatctgaaactagaggagattgacaactaattcctctcagaaagactgagtgacagtatcctgcaaatttccaccagggcagagacagctgtgcagtagtgccaataggcccagaaagcccaagacagccccattctgccagactggaattagagtagttgaatttttgcatgcacacaaaaagcatagaaattaacagagagagacttagtggacctggatgggtgtcaatattataataaaaaggatgcagagcatatagattaacagccagagacctacagggactcagacatcaggacattagaaacaataatgtcccagactggaccctaagcactgcaccccaacagatgccagtatgggccaggtgtccccaaccaatgccagaccaccagttaaggcctctacattccaccccaaggatggcgaggaggaaatctgaactgatggaagacatcctgaattgacttagaaagtcatgattttactgagaaaaccctgtatttacttaaagcaagctttctgacaccacgcaaagtggttaccagagttagaaattaggctgttatagaaaataaagctatcctggattgaacatctgagtaaattacaaaacatttacccgctacatctctattcaccagatagcgaactcaagcattcctctgcccctacataaatgacaaatgacattcacgtgtattacatatcccctcaggcctaactagggctgtgtgctgtttccaagaccaaaatgtcacaactgtaaaccactcacctggatacttgctataagaaatagcttggattagtatggaacttggtgtaaccctcaaatatgggagtttgtcactagaggtaccagaggaccacattctctgttaggggacctcgatgacagtatattacaatgaaggcagtgactggcaaacagcagcttcaaataggcatgcaaacaaacattgagaaacagtaagcacataagataactcatttagacacttttatatgcagcatgtataggatttaaaataacattcccaagttgaactgaaaccattactatgtaaatgccacagccaagtcaaatgaaatagtaaataccagccttgcaaattggtctccctcaagggcactcaaaagagttagactgcgtgctgctgccttaggaaatgtcctcctctctatcaatcatttctgctttgacatcaaacccattgaccagcatatgttttggaatttctgaacaactgactttcaaggattcacattcattctgcactttcttagaaacctcacaggagccactgttgccaataaaataaaataaaaaaacacaaacattataaatctaaccccaaaatgggattgcttcaaaagagaatggacaccccactccctacattgcttgtacacatctgtgttgattctcttggtgaactggcccatgcaagcaggagctcatcaatcagcagttgtcaccaagtgcaagtcagaattgctcaacagaaaaattgagtctttttttattccctattgtcacctactaaaatgtaagttgcttgttgatctcatcacactgagctatgtttcagggaagtgttgaaaaggcccagcctgcgcatattcttgaaattttgaaataatggctcagtgaacagatgtatactttctcccaatggctctttgtggaaatgaattttttatgagcccaaagtatctttgattcatccctgattaaaagtcaggttaaaactaaataccatatactttttgaaagacattttaggaagttattgacacaaggacttttgagactgaaaatcatgggttaacaataaacctttgtttggtgaaacaaaagaacagtacaggacagaggtgaaaagcacaggctccagggccagagtccctgggctcagattcttcacatttcagctctgtaaccttgaacaaactactccagttaatcataacttcagtcttttttaaaaaatgggatattaaataatgggtattaaataatagggttgccatagaggaaaatataaggtaatatttatatgcacataaaacagtgcctggcacagagccagtgttcaattagtactagctattttttggatacatgtagataaaagaagcatttaatgaatagttacatgcccattaacataaaatgtaagccacttccatattctgtagcttatggtgacaaagttttctgctcacgtattaactaaaaggagcgaagagcttccctataatattgaaaattttatcctaatggttccaaaggactgttttctaggaatgtttgctacagaaacctcactggttagatgtttgttggagcacactgtgattattcattgtcactgcaaactgtgtttaccacgggaggctgttctgactcaccactttgtgactcaccgattagtaaacagctaaatgtcgcattgctgatttaggtgtaatttactgcgtcaatataaaaggactctgcagattctactaaaatcaagaacatagctaaaggcattcttcatcgtaaaaacgaattttagaaaacaagatgactctaacagagttactttaaaatacaatgcaatatgtctattttaaatgacaacaatatctcctgtctgacagcattcaacttactttcagatttattcggtgttttctcaacttcacgagaaattgaaaatccataaaggagggaaatatgtcttgtttcattttcaatagttatatcaagaatacttttcaaaagtatttcatatttaccatgttttcagcaagtaactcttaacaatactctgagagtatgatcgtgatgataggtaaaaatcaggatcactcccttttcatctttacctgtgtagagcaatgtaatgtgcccttttcccaaaccctctgactccatgagggatgagacacagagggtgtggctgagggctcctaggaccgggactccttggctgatgtcctgtggcctgcagtccagggcttgcaggtgatcaaacaggaaaggagaaatgagggaggcacagtgctacgagcaggcctgtgttttcactgggaatggtggttagcagatgctcagatgtgtctcttctccctcacactcacctttggcttggctcttaactcctgcccacccctccctaaaccctctgtggaggtccggaactgagcgagtcacagacacccagcaagcagtctccagagaggcctctgtgcatgaagacttccccagaaggatgcccactcttcctacctggcctgggaactcaaaatgggcacaaaaactgaagactgtgagagagggtcagcttacaggccagaaactgacaataagattgatgttcaaatagctgaattattgattcttatcctgagatccactcctcattttcagtcttgcgataaaccttagtgaggggtgttttgtcttgtgttctatctattggtggatggattccaacttttctgaatatggggacgtaatttttaaagccaaaaattttgcagatagtaatggatttttaacatccattgattaacaaagtactatgaaaacagtaacacttttaaataaatttgctttcagtttttttaactaaacataatacatgcatgtatatatttaaacttatcacactgcctggcacagtgaaagcactcaaaaaatattagctataattactcctattgctgttgtttactcaatcataggtaatgcctggtatacatgtggattcttagagtccttatagaacacagcagcacataaactatactaggctctaaatcttctctcccaagaacttcatctgatgcatatttcaccagcaacagcagcatttagcactgtcttgctgtagaaaaattcttgataaattaattgaattaaatttatgtcacataaaatgtcatgaagagatggaagtgtcttggtcctgtatcttagcattttcaaacctctccattgttttttttttaatgtatagatttcacctgtgtaaaaattaaaaataagaaaactgatcctaatgctcttcatgaaaggcaagaaaagccttcttggaaagcaatagttatgggagagttctgccagaatttgttctcagaatgacatgagaacaattttattctaggaaatagaggtgctgaggactcagcttctgacctaccctagatcataaacatcactgcactaacagccaattaagaataatctaagctcttgtccttttataacagacctggttatgtcctaaaaaataagagcatttataaataaagaagaaagtttaacagttcaatagatcaacgtgactttccagctcctctctgaacaggtgacatctatttccccatcccttgaatctcagttggccttgtaacttatgtggatcaatagaatgtggccgaagtgacagctgtgcaagttctgagccctcacctcaagagcctttgcactctgtcacctgctctctcagacctcggcttttttccacgtgaataaaccgaggctaaccttctggaagaaaagagaccatatgaaacagaaccacatcagcctgaggccctggacatgtgcgaaaactgaagatcagcaaagctgacctgaaattgagtcacagttgacctcagatgcatgagaatctaaccaaggctgaaaacatttggttgaatcccacctcaatttctgacccagagatagcaactaatgtacaatatcatgattgttatgcagtcattagaaagaatatattagataaatgtgtattggcctggaaaaggtatcatctaagtatgcttaatgattatccatcttaaaaaaaaaatacagaaatagggttgtagaacaagggtcctggtcatactgagcttacacttctgttgatgaaataaaacacatatgagatgatgaggaaataattcaaccaacaagaaaatactttacaaccaagagacttattaaataaaatgggtgcaccttttataataccaataagtataatagtaccctaacacagtagacacatttctgttgtctgtagttatctttcagaaagccgtcttgggagaacctttaaatgacctcagagagcgaaggtttatgtaaataaagaattaagtcagtgtgggtagaggttcagcaccagggtgcaggaagttatgtgaagattgtggtatggggctcatgtctagaaacagagagtggccccatgtcagcctatgagggaggagccaggccccacctcaagggtctccttcaggaagatctctgtgggaaaggagcaggggttccaggttttcagcaaagcctgtgcttgggcaatccatcaacacggttagtccagggcccacatataacctctgacccttctcacatttattttctctgtctggtacttcctctaaggagcatcctgccactcaccagcccctaccaaacacacacacacacacacacacacacacacacacacactcatactctatttgctcataatctcataatcatccatcaggttttaactgagatagtacttcttctgggaactttctctggtgagagatcctcttatgtggctcttgacctaccaaaccagaagcagttgtgcaattagtgatcattattctcttatttattatagtatctccagcacttagcacaatatctgcagacagtgggcacgcactgaaaaaaaaatactttttgaatcaatgaattaaatagctagttttcattcaccctaagaaaataccaaacattggtcttaagaatgtcacaggcctgaaggtataaaggaggaagcaaggaaacaaaatcaacagacagagccttggcaaaatctgctgttcaccagtcctcccagcaaatccatttcccattctggggaagcaatgccaaacagctccaggaactctgtacatggtctgtcaagtatccaagacagaagggagacttttcaagagtggaagcccagcctgcttgctccagtctggactgtgctggtctctattttcctagtcagggatggccccaacctgggactgtgtctcctctcaggctctgaggccttgggaatggaggaatgtcgtatctgccagtggtttaggtctgtattgtgaagaattaactttcccaaacagagatctggccttcaccctcagctgctgggtggtgattcctaggctcctggattgtcctgccagataggagtatctttgtttgcctgagggctttggccaccagtcagtctaataacgtgatatatgatggggctttggaacatgccatgtgaattctgacctctggaggaaccagagatcattagctagaacctccaggaggggctggaggttaaaggtcagccacgtgggcagcgtgtgataaagctccaggaaaaactctggacaccaaaggctcagttgagctcctatcttctgcaacactccatgagttctgtcacacaacatggctgggaggaggtaacacacccaggtctccctgggagaggacaaccagaagcttcatgtttagaaccctcccagatttcacccaatgcttctctccctttggttggttctgatttgtacccttttgctctaataaactatgatcatgatcactttcctgagttttgtgtgttgtttcatggaactatcaagcctgagggagcatgggaactcccagatttgtagccagctagccaggagtaaaggcagcctggggacccggaacttgtggctgatgtttgcattgagggcagtcctgtggaggactgtgcccttaacctgtgaagcatggccacctcccggcagttgctgtgagaactcattgcagggccactcagggaagtgtgggaaattgaaccaatgatgcctgacaccacggcttcctgactatcctctaggaagtctatcaggagatgcccctgttcacttccctgtaggttccagcgaggctcagagggtcatcagttctaccaacaatatctgcgcagaagagagtagctgtgattttattttagtctgaaagaacactgtttgttgttgattaacacctaaatattacaaacagtctctcagtgtgagaagatttatcttattctcctgtgtaattagaatgattattcaacaaatggatgttatctagcgaacttccagaaagaagccaaatttatcaacctcaccaactcacacatacagccagggatctatattcttgtgctctcagagaaggcatggagcttggactgacagcaaaagaccaacaaaacacccagaagccagtcaaaaatggcccaggctgcaggatccttgaaagacctgaaaacacacgaggaaaaggctgggaaatagtaatggtgagtggacctctgcggtctggagaggaaactactggttattttaggaaaaacattcccataatggggctcagggaaaaaagaaagtaatggtatccaggccttattctcagaagcattctcctccctgaatccagtatctgaggtaactgagcagcagataaaaatagcattttctcgaaacaaagcaaaacattaaaaaaaaaatagcctactgtctaagctttgtctcccagtggaactcaggaaccaagccagcttctccagctgtgcaccttggctgtgtgtctcagatggaacatttctgacttcattccctcctcctcccacgtcactcggtaaggagggtgggccaggacaagcagctcagacagctgttcctacagctggccttaccacaatcccccaggcctcacatacatgcacctctgggccctgcctgcctgcactaaaccatccggcccagtgcaacagaccattctttcaagctgtctctctcctactcacaaccatcccaggagtcctcttaaaactattttttcggagaacacattgtgctttgccacactgttccatttatctcttggtggccattccatttgcctcagcaactctctatcccattttttagtactacccctgaacgagaaggcaatcttgttcatcttgccaactctaaatccttatcgcaatcgtgttgctttagattgcattcatgtgtgaataggtgtggataggtgtttggcactgtgttagatgccaaagatacagtgctaaggaaaaaacatacctgacaacagattttattatattccaacgggaaagataggataaacagatacataaacaatgtatatgcagattaggatgagtatcatgaaagcaataaataagaggctgacgggttcaatttaagtggggtggccagaaaatgcttttccttcttctgagagaagtgagcgaggggcacagagaagtccgaattgttacactaatgaatatttctgagcttgaaaacacaaaacaaggggagatgaggttccactcaacagaggtatatacacatcaattacatgacccagaaaacctgattcagacacaccttgctgacactactccatagggaaggtcattttcacttgtccacatctaccacacctccattttcactctccctgagataagaggatgtgcatttacactgtgtctgcctagcgaaattgtaccccccgctgaataaagcacagttagttgagattcacgaacaccaagcctctctttataatgactttagagagctgtgctaactgaccagcactctggatacttatgagcagatgtctggtagcaatggaacctctcatgaccacccaggctctaaatgactgttcagctcagcagctcattatcaccttcctggagttagagctccaacataagaataaatatctccatctagtattatcactttttaaatcaaaatctatattcagcttgagagtataaatatcaaaatttcagggcattttttctaacttttcttgggagattttagtaaaattccagggcagattgctgaaagtacaatctgggaacagaaactaatatagtgtcacatcatatgaagttaacctctttttcttatgcaattctatcaaacttcaaggaaattctttggaaatctgggccccactacatttaaaacaaaataggtctatcatgaaatgcctaataaaggttgatcttacagtgtgatcgaggtgctatgcagatctgagacaggtggattattccagaatgagaaagaaacacaggatgaataagtcgcactaatggcaatagcaacttctgggaaacaccaatttctggcagctgttgctttcgtcaacactttctcagcaaaattgccacagccatttctgagagcttagaagcactgctaggaatctctaataggagtctgtttaatgggaattcctattgactacagccgcttttgcatataggagataatgttgagctaagggaatctttcaatgattcattcaaaacatgtttatccaccatgtgataaacattatagtcagtgccatagtataaacttgaataatgcataatccctgcccccagggaactcacatccttctcgacatgcctagcacaaacacacagaattataataaaagttgtcaagaagaagatatgggtggcgcattatgcaagcagagaaaaagggactgccttattcatttagaagctactggccctctctagagattgttggtcttccagtacatctaaatattcttcaatcgtaaaatgccatgaagctagaagtacaaaatgctgtattatcagttaagccccctatttttttcttttttttttttttttttgagacagagtctcattctgtcacccaggctggagtgcagtggcacgatctcacctcactgcaacctccacctcccaggttcaagcagttctcctgtcttagcctcccgagtagctaggtttacaggtgcatgccaccatacccagctaatttttgtatgattagtagagactgggtttcaccatgttggccaggctggtcttgaggtcttgaactcctgacctcaggtgatccgcccaccttggcctcccaaagtgctgggattatgggattacaggtgtgagccaccatgcccagccagttaagcctcttaaagaatgtcttgaattataacaaacacatgatgcctatcttcccccatatctttatactgacaaaattaggttcaaaatcaaggcatggtcaccagaaatcaggtcagagggatcaagaaaacatggacagtgaagtgatttcacttccatacaggtgataaatatttcctaaaatacaggtagatgtgtggcacaaaacctccagactctgagcatcaaagtccctcctaataccagaaaggaaggacccagcatttgtcatctcagtctcagacaaatacatactcagagggcctcaggaacatatgtaaactaaaaaaaaaaacatgagaaattgagcaggagcctgagtttgggcttccttgggtgggtactgtattaatttcccataacaaaatactatggaatagtacacagatgtttctttcctcacatttttggaggcaggaagtccatgattgaggtgtcagcaggcttggattctcctgaggcttctctccttggcttgtgaatggtcatcttctctctctctctcttcacttggtcttttctctgtgcacaggcatcctttgtatttctccctcttcttataaggacataaatcctactggattaggaccttacccttatgacctcatttaacctcagttaccactttaaaagccatatcttcaaatacagtcacattgggggctagggcttcagcatatgaattttaggaggacagaattcaatccataatagatggggacagggcaattctcttcctaggtaagccttcccttagggccatttacggggagataaacaaaccccaatttctactgagcaaaagctcagagaccctgaagtaactgcagttagtaaatgagaaagacagaatattttcaatatcttcaagtctaatacctagaagtgatagaggtttattcacattttctcccagtcattttcttattctgtgtttatacagcatttctgttaatgacaccattattttcagaaatcaaaatgaaatcttaatgttatcattgactctccccccttccttgccttcacttcaatcataattttccatgtctatgtaagtattcttttggctatttacatattcatcagaaacctatttcagctcttattaattttcatgaagatcactaatggaagccacctattgttcatgcttctagttcaggtgctcctaatatgggaactgtatagtttcagttgatctataacctttcaccccccaggttttgtggttgtttttatatacactttcacacatataagtggtaatgtgttcattgctattatcagttgttcaaagtgggtccctcacccacgaacaggttaaaagccagagctctcctctctcctactacacttgctccttgtaaaaaaaatttaatctttgtgattaacacaattgtttatattcttccccctactcaaatactcccagttacaaacattttaacttgtagtttaaaatcgttcctggtcagcaatcccttctgtagactcttccaaaaattaccatggttcttataatcaatctcacacccaaaagaggagattttagaaaggcatagacaccagaaggcagggatatatctgtctaccacagtccaccgtctggccaccaatgactcacattaccctcacttgcaaaaatacattcacatacatccccaaaggtctcaagaatcttatctcacagagcttcagctcaaagtcaaacttttatgctttaaatcatggctaagttcaaacacagctcctgggcataatatatgaagtacagctcctggggtataacttctctccttctgtcaacctgtaaaactaaagaggcaagtgatctgcccccagtacacccgtcatacaattttgaaacaggcataactggtaggcatgggataacagctatagacatattggttcaaagggaggaggggaaaaagataacaaagagtcgttggtccatagcagttctaaaatctagctgggcaaatgttgggagttcaatgattaggttttagagcctaagattaatctcggctattggggaaaccagcccccagtatttcaacgtaggttcttttctattttccctaagtgtcggccagtctgagaaataaagagaaagagaacaaaaaaaagaaattttacagctgggtctccggggttgacatcacatgttggcaggttccatgatgccccctgagcctcaaaaccagcacgtttttattatggatttcaaaaggaggggggggtgtatgaatagggtgtgtgtcacagagatcacatatgatcacatgcttcaagggcaataaaatagcacaaggcaaatgggcaggacaaggtcacaaggccagggcaaaattagaattacagatgaggttccctgtcccactgtgcacgtattgtcattgataaacatcttaacaggaaacggggttcaagagcagagaacaggtctgactagaatttcatcaggctggaatttcccaatcctaacaagcctaggggcgctgcaggagaccagggcttatttcataccttatctacaactgcataagacagacactcccagagcagccattttagaggcctccccctgggagtgcattcttttcccagggctgttccttgctgagaaaaagaattcagtgatatttctcttatttgcttttgcaagaagagaaatatgactctgttccacctggccccgcaggcagtcagactttatggttatcttccttgtttcctgaaaatcactgttatcctgttccttttctaggtgcccagatttcatatttttcaaacacacatgctctacaaacaagctgggcagataacacaatcattacaggatcctgaggcgacatacatcctcagtttatgaagatgatgggattaagagattaaagtaaagacaggcataggaaattgtaagagtattgattggggaagtgaaaaatgtccttgaaattgtcaccatttatgttcttctgccatggcttcagccggtccctccgtctggggtccctgacttcccacaacacttggctctaccctcttgcctcttagcaccaccctctatcatccttcttctttaatgtttgcagttgagtagttttatcagcctgcttcctgccagtagaaatgttggggtctgacagcctcctttcatttcattttgtagtctttctatccctttcagtccaagccagtagtgtttctgctgaaataattttctcaagatctttgtgcatctaccatagatttcaatgatgttctgaccatcagaaaaaaacacacccacagatcttttccagacagcatatatttttggctcctgctcggatggctgaggggctacagtttgattgagtggatctaaaaggcacattcttaatctccttaaggagtcctttgtgccattgaatattctcaccttttagtctttgaggtttttttaacttttattttgagttcaggagtacatgtgtaggtttgttataaaggtaaacttgtgtcatggggtttgttgttcagattttttcatcacccaggtattaagcctgggtgtacacattagttatttttcacgatcctctccctcctctcaccctccaccctcaagtaggctccagtgtctgttgttcccctctatgtccatgtgttctgtgttatcatttcgctcccacatataagtgagaaaatgctgtatttggttttctctttctgtgttaatttgctaaggataatgacctccagcttcatcaatgtccctgcaaagggcatgatctcattattttttatggctgtatagtatttcatggtttatatctatcacattttctttatccaatctgccattcctggccatttaggttgattccatgtctttgctattgtgaatagtgctgcaatgaacatatgcatacatgtgtctttatgatagaacgattattattcctttgggtatatacccagtaatgggattgctaagtcaaatggtagttctgtttttaggtctttgaggaacagccatgctgttgctcctaatggttgaactaacttacactcccaccaacagtgtaagtgttcctttttctccacaacctcaccagcacattattttttgactttttaacaatagccattctgactggtgtgagatggtagctcattgtggtttttatttgcatttctctaataatcaggaatgttgagctttttttcatatgcttggtggctgtatgtgtgtcttcttttgaaaagtgtctgttcgtgtcctttgcccactttttaatggatttttttcttgtaaatttgtttaagttccttatagatgctgcatattagacctttgtcagatgcatagtttgcaaatattttctcccattctgtaagttgtctttttagtctgctgatagtttcttttgctgtgcagaagttctttagtttaattagatcccatttgtcaaattttgcttttgttgcaattgcttttgatgtctttgccataaaatctttgcctattcctatgtacagagtggtattgcctaggttgtcttccagggttttttttataattttgggtctttaatccagcttgagttgattttttttgtacatgatgtaaggaaggagtccagtttcaatcatctgtatatggctagccagttatcccagcaccatttattgaatagagagtcttccccattgcttgtttttgccagctttgttgaagatcaggtagttgtagccttatttctgggctctctattctgtttcattggtctatgtgtctgtttctgtaccagtaccacgctgtttttgttagtgtagccctgcagtatactttgaagtcaggtagcatgatgcctccagctttgttctttttgcttaggattgccttggctatttgggctcttttttttttccatatcagttttaaaatagtttttctctaattctgtgaagagtgtcattggtagtttgataggaatagcattgaatctataaattgctttgggccgtatggccattttaacaatattgattcttcctgtccctgagcacgggatatttttccatttgtctgtgtcatctctcgtttctttgagcagtgttttgcagttctgcttggagagatctttcacctccctggttagttgcattcctaggtattttattctttttgtggccattgtgaatgggattgggttcctgatttggctctcagcttgactgttattgctgtatagaaatggcagtgatttttttatgttgattttgtatcctgagattttgctgaagttgtttatcagttgaaggagctttggggccaagtctatgggtttttctagatatagaatcatgtcgtctgcaaagaaggataatttgactttctctcttcctatttggatgcaatttaatactttctcttgcttgattgctctagcaatctctttggcctgaaagccccctgaggacaaatacatcagtcaactgtttctttgtttgttgtttgttgtttcttttaaattattctcattacttagcacagatcatgtacaccatgagtgtttaataatatcaatagaatatttgggagcaggaggttattttgcttagttttatgctttcactgttgttgtagaacagctgggctagaagacattattaaacataaatacaactggtaaaatatcccagcagaagaaatgctttaaaaatatctccaatcactgcaggagtgcagagaggcaacaactcctccagcttttgcacatcgaataattggtttagttcactccttccacatcacttggagcagcggggagggtggggaaagcttaatgaccaggaaagcctttcataaagtcatcatcaatgttctttataacctaatgtcacttcaatagtccatggttttcaaataaatgtcctacctgcccacagactgaaattttagccaaataaatccataaatttaaacatattgacaatcaaaatggtaaaaagaacttttatttttaacttgtaaaaatggttttagaggtcatcaggaagaataaatgagatacatagccaaaaaaaatttaaatacttgccacatcagatattagaatgtgttctaaagctacgctaattaaaataatgaggtaccaatacaggaataggtaggtagagcaatagaagcattaagtataaacttataagagactcaagttataagttacaagaatttgacatatgttaaagttagcatctcaagccagaacagcatgtcaataaattgttgaaagacacctggataaccatcaggaaaacaattaaattagatccctacctcaacaactaaattccaaaggaaaaagactcataacatttttaattaaaaagcactggaagaatatatagatgaccttttacataactttgaaaaaggagaattatgttataaaaatcacaacaaaggcagaaattataaaagataaaattgacagatttgactaaatacatctttaaacatgtgaatattaaaacgctgtaaaaaattaaaagacaaataaagtagaaattatctaaaatatatatcaaagcaaaaactgcatttctatatgccactggtatataaaaatacttccaaatcagtaaatacaaattgcacacaaatagaaaatgatagaagaagctaacaggcatttcacaaaagaagattataaatgactgataaacacattaaaatgtctattactacataattaaagtaattctgaaaccaataaagtacttttttctgcataattctagggatttatgcttaggaaagaatttgtaataaagatccacacacaaagatatctatcagaatgtagtatataacaccacaaatcataaatgagtcaggtatggtggctcatgcctgtaatcctagaactttgggaggccgaggtgggaggaccacttgcagacaggagcgcaagacctgcctgggcaacataatgagatgctgtctcaaaaattttttaaaaagaaacaatttaggggggcggttccaagatggccaaataggaacagctccagtctgcagctcccagcatgagcgatgcagaagacaggtgatttctgcatttccaactgaggtatcgggttcatctcactggggcttgtaggacactgggtgcaggacagtgggtgcagcctatcgagcatgagccaaagaagggcgaggcattgcctcacccaggaagtgcaaggggtcagggaattcccgttcctagccaagggaagatgtgacagatggcacctggaaaattgggtcactcccaccctaatactgcacttctccaatggtctcagcaaatggcaccccaggagattacatcccgcacctggctcagagggtcccacgcccacggagccttgctcattgctagcacagcagtctgagatcaaactgcaaggctgcagtgaggctgggggaggggtgcctgccattgctgaggcttgagtaggtaaacaaagcagccaggaagcttgatctgggtggagcccaccccagctcaaggaggcctgcctgcctctgtagactccaccttggggggcagggcatagcaaaacaaaaggcagcagaaacctctgcagacttaaatgtccctgtctgacagctttgaagaggatagtggttctcccagcaaggagtttcagatccgagaatggacagactgcctcctcaagtgggtccctgacccccgagtagcctaactgggaggcatccaccagtaggggcagactgacacctcacatggccgggtacccctctgagatgaagcttccagaggaacaagcagcagcaacatttgctgttcagcaatattcactgttctgcagcctccgctgcagatacccaggaaaacagagtatggaatggacctccagcaaagtccaacagacctgcagctgaggatcctcacgttagaaggaaaactaacaaacagaaaggacgtccacaccaaaaccccatctgtacatcaccatcatcaaagaccaaaggtagataaaaccacaaagatggggaaaaaacagagtagaaaagctgaaaattctaaaaattggagggcctctccccctccaaaggaatgcagctccttgccagcaacagagcaaagctggatggagaatgactttgacgagttgagagaagaaggtttcagatgatcaaacttctctgagctaaaggaggaagtgtgaacccattgtaaagaagctaaaaaccttgaaaaaagattagatgaatggctaactagaataaccagtgtagagaagtccttaaatgacctgatggaactgaaaaccatagcacgagaactacgtgacaaatgcactagcttcagtagccaatttgatcaagtggaagaaagggtatcagtgattgaagatcatgaagtgaagcaagaagagaagtttagagaaaaaagagtaaaaagaaatgaacaaagcctccaagaaatatgggactatgtgaaaagacaaaatctacgtctgattggtgtacgtgaaagtgacagggagaatggaaccaagttggaaaacactctgcaggatactatccaggagaacttccccaacctagcaaggcaggccaacattcaaattcaggaaatacagagaatgccacagagatactcctcaagaagagcaactccaagacacataattgtcagattcaccaaattgaaatgaaggaaaaaatattaagggcagccagagagaaacgtcaggttacccacaaagggaagcccatcagactaacagcagatctctcagcagcaactctacaagccagaagagagtgggggccaatattcaacattcttaaagaaaggaattttcaacccagaatttcatatccagacaaaccaagcttcacaagtgaaggagaaataaaatcctttacagacaagcaaatgctgagagattttgtcaccactagtcctgccctacaagagctcctgaaggaagcactaaacatggaaaggaacaaccagtaccagccactacaaaaacatgccaaatcgtaaagaccatagatgctaggaagaaactgcatcaactaatgagcaaaataaccagctaagaacataatgacaggatcaaattcacacaatattaaccttaaatgtaaatggactaaatgctcaaattaaaagacacagactgtattcaggagacccatgtcacgtgcagagacacacataggctcaaaataaaggaatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcagccagattcataaagcaagtccttagagacctacaaagagacttggattcccacccaataataatgggagactttaacaccccactgtcaacattagactgatcaatgagacagaaagttaacaaggatatccaggaattgaactcagctctgcaccaagtggacctaatagacatctacagaactctccaccccaaatcaacagaatatacattcttctcagcaacacattgcacttattccaaaattgaccacatagttggaagtaaagcactcctcagcaaatgtaaaagaacagaaattatagcaaactgtctcttagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacatgccagaatctttgggacacacttaaagcagtgtaaagcagtgtgtagagggaaatttatagcaataaatgtccacaagaaaaagcagaaagatctaaaattgacaccctaacatcacaattgaaataactagagaagcaagagcaaacacattcaaaagctagcagaaggcaagaaataactaagatcagagcaaaactgaaggagatagagacacaaaaaacccttcaaaaaatcaatgaatccaggagctggttttttgaaaagatcaacaaaattgatagactgctagcaagactaataaagaaaaaaagagagaagaatcaaatagatgcaataaaaaatgataaagaggataccaccaccaatcccacagaaatacaaactaccgtcagagaatactataaacacctctacacaaataaactagaaaatctagaagaaattgataaattccttgacacatacaccctcccaagactaaaccaggaagaagttgaatccctgaatagaccaataacaggctctgaaattgaggcaataattaatagcctaccaaccaaaaaaagtccaggaccagatggattcacagccaaattctaccagaggcacaaggaggaactggtaccattccttctgaaactattccaataaatagaaaaagaaggaatcctccctaactcattttatgaggccagcgtcatcctgataccaaagcctgacagagacacaacaaaaaaagagaattttagaccaatatccctgatgaacatcgatgcaaaaatcctcaataaaatactggcaaaccgaatccagcagcacatcaaaagcttatccaccatgatcaagtgggcttcatccctgggatgcaaggctggttcaacatacacaaatcaataaatgtaatccagcatataaacagaaccaaagacaaaaaccacatgatttttgtctcaatagatgcagaaaaggcccttgacaaaattcaacagcgcttcatgctaaaaactctcagtaaattaggtattgatgggacatatctcaaaataataagagctatttatgacaaacccacagccagtatcatactgaatgggcaaaaactggaagcattccctttgaacactggcacaagacagggatgccctctctcaccactcctattcaacacagtgttggaagttctggccagggcaatcaggcaggagaaagaaataaagcgtattcaattagaacaagaggaagtcaaattgtccctgtttgcagacgacatgattgtatatctagaaaaccccattgtctcagcccaaaatctccttaagctcataagcaacttcagcaaagtctcaggatacaaaatcaatgtgcaaaaatcacaaacattcttatacaccaataacagacaaacagagagccaaatcatgagtggactcccattcacaattgcttcaaagagaataaaatacctaggaatccaacttacaagggatgtgaaggacctctgcaaggacaactacaaaccactgctcaatgaaataaaagaggacacaaacaaatggaagaacattccgtgctcatggataggaagaatcaatattgtgaaaatggccatactgcccaaggtaatttatagatataatgccattcacatcaagctaccaatgactttcttcacagaattggaaaaaactactttaaagttcatatggaaccaaaaaagagcccacattgccaagacaatcctaagccaaaagaacaaagctggaggcatcacgctacctgacttgaaactatactacaaggctacagtaaccaaaacagcatggtactggtactaaaacagagatatagaccaataacagaacagagccctcagaaataataccacatatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatattagatctaaaactataaaaaccctagaagaaaacctaggcaataccattcagggcataggcatgggcaaggacttcatgtctaaaatgccaaaagcaatggcaacaaaaggcaaaattgacaaatgggatctaattaaactaaagagcttctgcacagcaaaagaaactaccatcagagtgaacaggcaacctacagaatgggagaaaatttttgcaatctactcatctgacaaggtctaatatccagaatctacaatgaactcaaacaaatttacaagaaaaaagaaaaaacaaccccatcaaaaagtgggcaaaggatatgaacagacatttctcaaaagaagacatttatgcagccaatagacacatgaaagaatgctcatcatcactggccatctgagaaatgcaaatcaaaaccacaatgagataccatctcacaccaattagaatggcgatcattaaaaagtcaggaaaaaacaggtgctggagaggatgtgcactgttggcgggactgtaaactgattcaaccattggggaagacagtgtggcgattcctcaaggatctagaactagaaataccatttgactcagtcatcccattactgggtatatacccaaagcattataaatcatgatgctataaagacacatgcacatgtatgtttattgtggcactattcacaatagcaaaggtttggaaccaacccaaatgtccatcaatgatagactggattaagaaaatgtggcacatatacaccatggaatactatgcagccataaaaaacgatgagttcgtgtgctttttagggacatggatgaagctggaaaccatcattctcagcaaactatcgcagggacaaaaaaccaaagaccgcatgttctcactcataggtgggaattgaacaatgagaacacttggacacaggaaggggaaggggaacatcacacactgtggcctgttgtggggtggggggaggggagagggatagcattaggagatatacctaatgtaaatgatgagttaatgggtgcagcacaccaacatggcacatgtattcatatgtaacaaacctgcacattgtgcacatgtaccctagaacttaaagtataaaaaaaaatgaaggaaggaaaacaaaaaacgcaaataaataaataaataaataaacagtttaggccgggcacagttgctcacacctgtaatcccagcactctgggaggccgaggtggccagatctcctgaggtcaagagttggagaccagcctggacaacatggcgaaacgctgtctctactaaaaaatacaaaaattagctgggcatggtgtcatgtgcctgtaatcccagctattcaggaggctgaggctggagaatcacttgaactctggaggtagaggttgcagtgagctgagatcatgccactgcactccagcttgggtgacagagcaggaatccatctcaaaaaataaaaatagaaaaataaaaataaaataaaaattaaaaataaacagtttaaacgtccaacactagtgacttggtaaaataaaatttagtacatccacataatgtaatgctattgtcaaatgaagttatttatggatatttgttgacatgaagaaatgtttgtgaatcataatatattagtcagttgaaagaaagttgctgacattataaactgatgtttggctaaattataagtacagatgcacgcatatagtactatgggtatataacagggttagtatatatatatgtatatatgtgtatgtgtgtgtgtatatatatatatagtgtgtgtgtatatgtatatatatagtgtatatatatacacacatatatgtgtgtatatatagtgtatatatatagtgtatatatgtgtatatagtgtatatatatacacacatatgtgtatatatatgtgtatatatatacacatatatgagtgtgtgtgtgtgtgtgtgtgtgtgtatttatatatatgctttcttgctctgccagctgaaaagcaataacaccccagtagcaacaagcatggctaggtaccagaactcgctttgtaatcccattttccaagaaaataaatcagagctctctggagaaatgtctgattctagggctgggacaaggaatatacaagataggtctggagaaagttacagtgccagaaagtaagcaagtgctcaaaaacaaagaaaaaaactcacaatgatgggagtatgtaaaaaggaggtaagagccaattggaaacgttccgtttggctaaagccagaacaattggagcaataaaataaagtagtactgagtaataatccaaggtgtaaaacaaatatcgtgtgtcaatactgatataaataaatgattgaataaataaatggggagaatagacaaatctcccatgcagaagaattccaaataatttacttggagcataaagtgatagaatgtaactccctcctcaagtgtgggccatacacagtgatgtccttccaaagagcacagtatggaaaggggtaagaaagagcaactttacagtggtaaaatctgacaaacatggcctcagtcaagtgatcaaggttgacgtcaacagtagtaagtcacgttgacagtatgaaccttgatatggtgtgaggagaaatggcatgctacctatggcgtcttcttcccaaaaatgtataacctcagtgtaatcatgaggacatcatcagacaaatcccaattgagggaaattctacaaaatactgaaagggagctctttaaactgttaaggtcatcaaaaacaaggaaactctgagaaattgttacaaccaaaaggagtctaaaaagacaggattaaatgtaatgtggtatcctggctagaattctggaacaaaaaaaaaattaggtaaaattgaagtaaatctaataaagtatgaactttagttaataacaatgtatcgatattggtccattaactatggcatgtgctgctgtaagaagttaataagaagccacactggatagggatttatgagaactctgtgtactctcttcacaacctgcccacaaatccaaactattccaaaattaaatttcttcttttaaaactaagtttcatatgacttgatttttgttaagggaggattacaattttatgtatagctgtgtcattatagatatagctatagacatggatatagatatatagatatatagaaatatagaaaagcatttagctgtgctgtctaatacacagccattacctagatatagctattgaacacttggattgtggctaatccaaattgagaagtgctgtaagtgtgaaatgtacaacagatttcaaagatgtaatatgaagaaaagaatataaacaatatcattaatgttgtgttttgagacagggtctcattcttttgtccaggctgaagtgaagtagtgcgatcacagatcactacagcctcgacctcccaggctcaagcaatcctcccacctcagtctcccaagtagatggaactaaaagtgtgcactgccacacctaatttttccatttttatttattttttatttctaggtttactcaaaaacattattactcaattcataaaatagtaattcagttagctggtgcctaaagactgaaaaaattgtaattttccaggcatttacagtttggggaacaaaaaacatgagacctacttgaaaaaatagaggctaataaataattaaggataaggctctaaaaaataacagtattgcaagctatttttaaagagaaaaatttgatagcaaaatgtttctctgactttgtaaatgcacaagaaagatcaacagttttatcacttgcagaaaaggcaattaatgtaatagaaaatgtgatgataaacttctaagaaactaagtgcttatgtctatttaacaatagaagttttacctattaccatttactattcatgtgtcgacagcaatccccttctctcccaactaggcctttcacaattatggaatatagacataaaatattattcctagatacattttacaaaataaaaatgagtaaatggaaaaaaggcaagttaaagtagttatatatatatattgaaaagtgggtgaataaactgaattactttcactaaaatgactatacaatagttaatgtatttcttatttatacaaggggaaaactggatataatatatctttaacattacacagtcatagaaaaatgttaactttaacctgataaaatcctttccccacatgttttacactttggattttctttcaatgtttattttggatccagagggtacatgttcatgtttgttacatggatgtattgcatggtgctgaggattggggtatggataatcccatcacccaggtagtgagcatagtacccaatgagtaaattgttaccccatgacccaccccaccctctaggagtccccaatgtctattattcccatctttttatccatatgtactcagtgtgtagctctcacttgtaggtgagaacatgtggtatttggttttccattcctgcatatattcacttaggatgataacctccagctgcatccatgttactgattttgttctttttaatggatgtgtagtattccatggtgtatatgtaccacttttttctatccagtgtaccattgatgggcccctaggttgattccatgtcttagctattgtgaacagtgctgcaataagcatatgagtacatgtctctttttggtataatggtttcttttccttggggcatgtacctaggaatgggactgctgggtggaatggtagttctgttacaaattatccaagcagagatctccagactgctttccacagtggctgaactaacttgcattcccaccaacagtgtataaacataccattttctatgtagccttaccagcagttgttatttcttgactttttaataatagccattctgactggtgtgagatggtatctcattgtggttttgatttgtgtttctcttatgattagcaatgatgagcattttttcacatgtttgttgactgcttgtatgtcttcttctaagaggtgtctgttcatgtcttttgcccatttcttaattggattgtttgggtttttcttgctgatttgtttaagttatttttcctattcagatgacttttatttctttctctagcctgattgctctggctaagacattcagtactgaatgttgaataggagtggcaagagtaggcacccttatcttgttccagttctcaaggggaatggttccagcttttaaacattgagtatattgctggctataagtttgtcatagatggctcttgttattttgaagtatgtaccttcaacgcttagttttttgaggatttttatcatgaagcaatgttggattttatcaaaagcttcttctgcatcaactgagatgacatatggttcttgtttttaattatgtttatgtggtgaatcacatttattatttatatatgttgaatgttgaaccaaccttgcagcccatcaataaagcctacttgatcatagcgaattaacttttttatgtcacgctggcttcggtttgctattaacagtattttttttttagatggagtctcactctgttggccaggctggagtgcagtgttgcaatctcagctcactacaacctcagcctcctgggttcaagagattctcctgcctcatggagtacagtggtgcaatctcagctcactacaacctctgcctcctgggttcaagcaattctcccacctcagcctcctgggtagctgggattacaggtgcacaccaccctgcatggctaacttttgtatttttaatagagacagggtttcaccatgttggccaggctagtctcgaacatctgacctcatatgatccacccatctcagcctcccaaagtgctgagattacaggtgtgagccacctcacccagccagcagtttgctagtattttgttcaggatttttgtgtctattttcatcagggatattggcccgaagttttctttttttgttatgtctctgccagattttgttatcaaattaatgctaccttcatagaatgagttaaggagaagcccttcctccttggttttttggaataacttcagtgggattggtaccagttctttatatatctggtagaattcaggggtgaatccatctaatcaagggctttttttgttggtggtggtggtttttttttattactaattcaattttggtacttgttattggtctattcaggctttcactttcttcctggttcaatcttgggagtttgtgtgtttccaggaatttatcgatttcctctaaattttctaatttgtgggcatagaggtgtttgtaatagtctctaaagatcttttgtatttctgtgggatgagctgtaatgtcatctttgtcatttctgattgcacttatttggatcttcacccttttacaaatttcttaatctacctagaagtctatcaatctttgtttattctttcagaaaatcaactctcagtttcattgttcttttgtatagattgtatgtctcaatttccttatgttcttctcagattttagttatttctattcttctgctagctttactgttggtttgttcttatttttccagttcctctaggtgcaatgttagattgtaaatttgggatatttctagcttcttgatgaagacgtttagcactagaaactttcctcttaacactgctttagccgcatcccaaagattttggtaagttgtatctcttattttcactaatttcaaagattttttaaatttctgtcttaatttcatttttcacccaagagttattcaggaaaaagttgtttgattttcatgtttatgtgtagttttaagagatcttcttggtattgatttctatttttattgcattgcaatctaagagtgtgctcggtatgattttgatttttttaaatttattgagactcgctttgcaaccaagcatgtggttgatcttagaatatgtacctgtgtggatgagaagaatgtctattctgtggttgttaggtggagcattctatagatgtctactaggtccaattggtttagtgtcacgtttaaatccagaatttctttatcagttttctgccttgatgatctgtctagtggtgtcagtaaggtgttaaaataccccactattagggtgtagctgtctacaccttgatcttttcatagatcaagaagaacttgttttatgaatttgggtgctccaatgatgagtgcttatatatatttaagatagctaagtattcttgtttaattgaaccttttatcattatgtaatacccttctttatctttcctgaatgtttttggtttaaactctgttttatctgatataagaatagtgactcctgctcttttctgttctccatttgtgtggtacattttttcccatccctttactttgagcatgtgagtgtagttacacgtgagcttggtctcttgaagacatcagaaaattgggtcttgagtttttatctagcttgtcactctgtgtctattaagtggggcacttagaccattttacatactgaattagtattgatatgtgggattttaatcctgtcattgggttgataattggttgttttataaacttgattgtgtaattcctttatattgtctgtgagctatgtgcttagtatgtttttgtcataacaggtattaatctctcatttccatgtttagcattcccttaaggacttctcataaggttggtctggtggtaacaaattcccttagagtttccttctgtgttaaggattttacttcttcttcacttatgaagcttagtttggtgagatatgaaattcttggttggaatttatttgctttgaggatgctgaaaataggtctccaatttcttttggcttgtaaactttctgctgaaaagtctgctgatagtgttgtgggattccagttataagtgacctgacctttctctctagttgtctataatattttttcttttgcattgaccttggtgaatctgatgactatgtgccttggggatgatcatcttgtatagtattttgctgggttctctgtgtttcttgaatttgtatgtcaatctctctaacaagattggggaaattttcatagattatgtcctcaaatatgttttccaagttgcttactctctctctttctctctcaagaatgccaataaattgtagacttgatctctttacacaatcccatatctctcagaggttttgttctttttttaacattcttttttctttatttttttctgactgagttgatttaaagaacaagtcttcaaactctgagattctctactcagtttggtctattctgctgttaatgcttctgattgtatgtggaaactcttgtagtaaatttttcaattccaggagttcagtttagttctttcttaaaatggctattttgtctttcagctcttagatcattttaccggattctttggatttcttggattgcatttcaactttttcctggatctcagtgagcttctcaccatccaggttctaaattctatacctatcacttcagtcatttcagtctggttaagaaccattgctgggggctactgtgctcatttggaggtaaggagacatcctggctttttgaattgccagagttcttatgctgattctttctcatctgagagggctagtgtttctttaagttgagtatagtcagttggcttcatttctgggtgctttcagagggccaaggctctgtacaggatctttatttgtagctgaattcttgtcttaggtttcacaggcactgtacattggcaaaatattttggcagttgtaatttggactgtgatgcagtagatggtgtttaagagtgatgaccaacagataggctcttattcagccatgcagctcttttgtatttcaccatgttctcaatagtgctctgtggtggggtaaggcagagagataactccctcaccaggttcactcctgggccttggaggagccccctccaatcactggggtcatgcccaagtttcctttgttaggtgttctgggctgtggggctccctcagatagaggtcatggctggcagacaggccacttccttcccagaccagccctgtggagagaggcaccccactttcatgctggtccatgaaccagggcatctcaaccctctcagtgttttgagagtgagaacatttcccccactcaggcaccaccaagccagtgagtcttgcctatctaagtacagaaggaccatggaggtcgcatggtcagccatcagggtctccattttttgtggggacagaatcttactatggtgctcaggctgactgtatgttgaaatgacaatattttaggtatattgggttaagtgaaaataattttatatatttatttatgatttcctttaatgtagtcactaaacattgttaaattatatatgtggttcatattgtatttctactgatagcagttgtttaaaaggatagacatgagaatgttaacaatagctattcctagtagtaaagtgtaatttttagcttttcttttttctaatttttcttgaataaatatgtgttccttgtgtaattttaaaagtaataaaggtaaaaatacacaatgaactactgctgtgaaatataccactaacagaagtactaagcagaaatgtcaagtcttagagtcctaattatttattcatttaaatacatatatattaagtgtctcatgtgcaaggcatttggacagttgctaggaaaataaacacaaaaaaagatgagctataattattttcttcaaggggttcacagtccattttggaagttaggctcatgaatagaatattagagtacaatgcggtcagtgatactatggtgatttgtattaactctcctccccttctgctttaaatgttgctgtttttctggctctaaccttagtctacttctctgcccacaacacaattgcaactaacacctatatactaatggctatggctttaactttgactttgcttcagatctctacatccaactgtcttttggtcagatggccattgggcaacctaaactgtatgcctaaaacccatcatctcttcacctcccctgctccagactcttctacctccgtaattcttgtctttgttaatgatgccaccatttaaccagttgcctcatgactctgtaaaaaggaaatttagttactttacttcacttctcaaaattcttcaggcttggcagtgcacaagcctacatatgcccttagctaccaatccaacttcatctcctggaacacttctcatcagcattgacactctagaaataccaaactaccaaactcaggaaacatcacaagttatcacttctcttcctttcattgttgcgtgtgtccttccctctgcttgaagtgtccaacctcatcaccacctcttcttcatggttcctagacattcctctctgatacctcccttgatcttccaggcaaattaggctctcttctctctggctccccttgaactttgtacatacctccaacatagtgattttcccattatattataataccagctttctgtatgatactctattccctaaggacagagattgtatctcattaaccttggtatcctcagcgtcacacggaatgtgacagacagaaaactttcaagtttactgaatatttcctatctttctttaccttttccactctattgtggtcactcttaccctagaataatgtagatgttccttgaataccaaccaggcttcacttctgggtctttgttcttgaatggccttaccccagatggttccctctgataaaccaattagtcactgctcagaagtcacctcatcagagaggtttttccttcaatcctgtataatatagtgcctggcaagaaaaggatgccctctctcaccactcctattcaacatagtattggaagttctcaatcaggcaagagaaagaataaagggtattcaaacaggaaaagagtaagtcaaattgtctctgtttgcagatgacatgattgtatatttagaaaaccccatcgtctcagcccaaaatctccttaagctgataagcaacttcagcaaagactcaggatagaaaatcaatgtgcaaaaatcacaagaattcctatacaccaattatagacaaacagagagccaaatcatgagtgaactcccattcacaattgctacaaagagaataaaatacctaggaatacaacttacaagggatgtgaaggacctcttcaaggagaactacaaaccactgctcaaggaaataagagaggacacaaacaaatggaaaaacattccatgctcatggataggaagaatcaatatcataaaaatgaccatactgcccaaagtaatttatagattcaatgctattcccatcaagctaccattgactttcttcacagaattagaaaaaactactttaaatttcatatagaaccaaaacagagcccatatagccaagacaatcctaagcaaaaaaaaaaaaaaaaaaaaaagaaacaaagctggaggcatcacactacctgacttcaaactacactacaagcccacagttaccaaaacagcatggtactggtacaaaaacagatatagagaccaatggaacagaacggaggcctcagaaataacaccacacatctgcaaacatctttgacaaacctgacaagaacaagcaatggggaaaggattccctatttaataaatggtgttgggaaaactggctagccatatgtagaaagctgaaactggaccccttccttacaacttatacaaaaattaactcaagatggattaaagacttaaatgtaagacctaaaaccataaaaccctagaagaaaacctaggcaataccattcaggacataggcatgggcaaagacttcatgactaaaacaccaaaagcaagggcaacagaagccaaaattgacaaatgggatctaactaagctaaagagcttctgcacagcaaaagaaactatcatcagagtgaacaggcaacctacagaatgggagaaagtttttgcaatctatccatctgacaaagggctaatatccagaatctacaaagaacttaaacaaatttacaagaaaaaaacaaccccatcaaaaagtggacgaaggatataaacagacacttttcaaaataagacatttatgcagccaacaaacatgaaaaaaagctcatcatcactggtcattagagaaatgcaaatcagccagagtgagataccatctcccacaagttagaatggtgatcattaaaaagtcaggaaacaacagatgctggagaggatgtggagaaacaggaatgcttttacactgttggtaggagtgtaaattagttcaaccattgtggaagacagtgtggcaactcctcaaggatctagaactagaagtaccatttgacccagcaatcccattactgggtatacacccaaaggattatgaatcattctactataaagacacatgaacacatatgtgtattgtggcactattcacaatagcaaagatttggaaccaacccaaatgtccatccatgatagactggataaagaaaatttgcacatatacacgatggaatactgcgcagctataaaaaaggatgagctcatgtcctttgcagggacatgaatgaagctggaaaccatcattctcagcaaattatcacaagaacagaaaaccaaatactacatgttctcactcataagtgggagttgaacaaggagaacacatggacacagggagcggaacatcacacaccggggcctgtctgggggtcagtggactaggggagggatggcattaggagaaatacctaatgtaggtgacgggttgatgggtgcagcaaacaatcatggcacgtgtatacctatgtaacaaaactgcacgttctgcacacgtaccccagaacttaaagtatatatatatatatatatatatatatatatagtgtgtgtgtgtgtgtgtgtgtgtatttaaaaaaagatactttcctaattaaagatagtttcctaccttgaaaaatctctaatgccagctactaaagtaacaatttctcacttatccacaggggttatttctggccagtgagatgatgaatgactgttttatgttaatttttaattttatagtattctcatgggattaaaataattccgctaaccacaaaaaaaaaaaaaatcaggaaacaacagatgctggagagaatgtggagaaacaggaacagttttacactgttggtgggagtgtaaattagttcaaccattgtggaagacggtgtggcaattcttcaaggatctagaaccagaaataccatttgacccagtaatcccattattgggtagatatccaaaggattataaatcattgtactataaagacacatgcacgcgtaagtttattacagcactattcacaatagcaaagacttggaaccaactcaaatgcccatcagtgatagactggataaagataatgtgccatatatacatcatggaatactatgcagccataaaaaggaatgagttaatgtcctttgcagggacatggatgaagctggaaaccatcattctcagcaaactaacacaagaacagaaaaccaaacaccacatgttctcactcataagtgagagttgaacaatgagaatatattggcacacggagggaatatcacacaccagggcctgtcggggggttgggggctggggagggatagcattaggagaaatacctaatgtagacaaggggttgatgggtgcagcaaaccaccgtggcacacctatacctatgtaacaaacctgcatgttctgcacatgtatccaataacaaagtataatataaaaataaattaaaatttatattttatatatattgaaattatttatatattttgaaatatattatatatatttatatataaatatatattatatatatatatataaatatatattatatatatttatatataatatatataatatatatttatatataaatatatattatatatatttatatataaaatatatattttatatattccaccagaatataagcatcaactgggatctaattaaactaaaaacttctgcacagccaaagaaataatcagcagagtaaacagacaacccacagagtgggagaaaatatttacaaactatgcatctgacaaaggactaacatccaaaatctacagggaactcaaacaaatcagcaagaaaaaacaaataattccaaccaaaagtgggttaaggacatgaatagacaattctcaaaagaagatatacaaatggccaacaaacatatgaaaaaaaatgctcaatataactaattatcagggaaatgcaaatcaaaaccataatgtgataccaccttactcctcctacaatatggctataatttttttaaaaatccaaaaatcaaagatgttggcatggatgtggtgaaagagaacaattttacactgttggtgggaatggaaacctatggaaaacagtgtggagattcctcaaagaactaaaagtagatctaccatttgatccagcaagcctgctcctcagtatctacccagaggaaaacaggtcattatacaaaaaatacacttgtgcatgcatgtttatagcagcacaattcacaactgcaaaaatatgggaccagcctaaatgcccatcaaccaacgagtggataaagaaaatgtatacacatatataccatggaatactactcagccataaaaaagaatgaaataatggcattcacagcaacctggatgaagctggagaccatcattctaagtgaattaactcaggaatggaaaaccaaatattgtatattctcacctataaaagtgggatttaagctatgaggatacaaaggcataaaaatgatataatggactctggagactcaggggagaacgggtgcaccaaaatctcagaaatcaccctaaagaatggacccatgtaacaaaaacctcttgttccccaaaaaattattgaactaaaataaaataaaagtcattttttataaaagaatctaagtatcaaaaagcccaggactttgtctgaattattcaacaaatgaataaagatctgatacatgtataaataagtaaatgatgttatttatcacctaaatatgacactgtctctctgactttaattttcctttcatctgcttatttttcttcccaagccatgaatatgggacaaaaaaaagggattaagacacaaacaccaagaattggcaagtataatgaggctgaacttgaaaaataacaatagttcaggtaaccatatattaaatttgtctcaagaatttattttattttctcattcatttattcaacaaatatttacatcacgcctattatgagttctttttgaaaatgcaataactgtctcttacatttgtaccattgtttatagtttacaaggtcctttctgatacttattttaacgtatcctcataaacaattctttgaggtaagcaggtcttatgaggaatgagtcttatgaggaatgagttaccagattaaggatcattgggttgtaaaaatcttgagctagaaagcattccatcgttttattgttgatacaactatatacagaagcccattatcaatctatttatttcaccacagagagctataatacacccattgaccatcagtaccagtatattaattttcacttctgggatttccagcctactcttagcttcaatgttagtgtgaatatttcatggtagaatgcacaaactttgaggaaggtgcaatgctttccctgtttcttccacttatgttcaggttctgcacatactgtatgttctccataaatatttattggtgaagagaacagttattaatgtaagaatctctctattcagaaaatatccaaggaaactgtgatagctgctggtttccaaagatggtcttccaatgaactatgtctctcagtattcggaattttgcataattccttccccttgatctggactggctctgtgacttgattataaccaacagaacatggtggtgggttaagcaatactcatttcatagggggcatttctggtcacatgatacttaatggtccatggtcaaatactaggatccagcaaagagccaagagctgtttctcaaaaaaaaaaaaaaaaaaaaagaaaaagaaaaagaaaaaaaaagaaaaaagaaaaaaaaagttatctgcagagtatggcatggctttgctcccagattctaaaagtctgttctggaatttacctaagaggcctgccaaaagctcaataggcactttaagcaccactgaatcagatgtgtcatatgaccaaagtggcagggaagcttgccaccctctcacaagggcttgtctttcgccaggccttattcaaaactggaagcctttcagattactcattcagcaaataggtttagactataacaacacacccaaataagatatgttgcctccaaaatccaatgaggcacaccagaaattgggactctttctttatggtaggagagaccagatgtagcattgaacttcaccttgaaagagatatctcaactttccccagaccatgaaaccccaagaaagttcctgaaggagcaaacttctaaatttttctgggatttatttcacaacctcttgcctctatgggtcttaccaaggtgtctaaagtagttgcgatttcctggtccaccagtgtagaggatccatgtggtgtgttgtgaaatgaagaggcaatcaatttcctgtggaatagaataggccagggttggagagttgatataaccctgaggtgaaacaaggagggtaccttgtttcacccttccagatgaaagaaaaatgcttctgatagtctctactaacatgtatatagaggaaaaaatgacttcccatatcagtattcatatattagatgtacatatattgatttactatagcaatgaaaccacatctggaacagcagctgtgattgtactcaccacctgattaagtttacaataatcctttgtcattcttcaagatccatctgtcttctgcacaggccagatagttgagttgaatggaggtgtggtgaaaatcaccagccctgcatcttttaaatcttttatagaggcactaatctctacaagtctctacagaatgcagtgctgctgtggatttactagtttggaatacaaaggcagttctaatgccttctacttgtcctcactcctcagatcagataatcaatgtagttattctgcctttcctgagtgtgcctccttcagttaagcattctagaacttgggaaataaccatggggtaagttcagagctaactggatgcaatatgagatggacctgagccaaaataccattaatcattcagcttcaataaacccctactctggtaaataggcaatagtagcatattgtgtctccaaggactggtatcatttcagagccaatgtccagaaatcccccaaaggtctggttatttacccttcccaaatgcactatgaccttggcaaatggctttaggtcttttcagggaaggaaagaaagagaaattacagtctaaacttttggaatgtaaatataaattagaaaaaatcctgcagtccttttggcaggcagggtacctcatcattttgttcctgccctgatatgggttgccaggagttgagtctagctataggcatacaaacagtgaaagatgttgggggtgagtcttgaggggtctcagcaattttccacagagtaagtccttacagccttttcaatcaagggaggactaaactcctcagagggaaaggctgcttctgctgggaaaggagacagggctttcaaggttctcagcttccaaagaatctgcctacatgttgccatctcaattttcaggggaggaaagaaggagaaattacagtctaaacttttggaatgtaaatataaattagaaaaatcctgcagcccttttggcaggcatggtacctcatcattttgttcctgccctgatacagcctgccagctctgtcccaatcaaagccctaattttaactgtaagaccttcaattgaattgatgttctaatctagctagctgcaggatcagtctttgggcttggttttttgaaatatcagatcttgcagctatgagagataagagtttctttcagagtagtcacaaagacttttcagtcccttgcctgcatcttgaactgaacattcaacactctgagtttatttctttttctccatattctctgtgacactttgaagcaacccacaaactccagtcctcatactccttacttccactacattggtctatggcagcatctacctggtaatctaacaccttgccttctataagcacttgatatcaaggactactgtgtcccatttaccattggcagtatagtcactaatgcttcatcgaatcagagaatcaacaccaaattcccatccttaaaattctatctctggattcacttccaacaccaatagttgtgtcagttaagagtcagtcagggaagcagaaccactgtgaatgatacagaatataggaatagtggattcgttgtggaatcagaccttacaaatgtgagagaagctagagaaggaaaggtctggaagaaggagtcagaagatcagaaaaagggtcattaacctgtctatcttatgcagtagcacagatggaccagacaggctggggcttgggggaaatctaggaagctaaacactttcaaccaccaaagtgggactgtgaaggggagctcatgaagaactgtatggagagtggttacctgtctgtagcaaccacttctgtgggtccacagccaagtagttggtgatgggtctcgagtcactgttgttcagcagagccaagagtcagaaagattcgctggatgcagagtgaaggaaagcaaggactatatgggacctaccaagcatctctccctctgtccatcactgtatgtgaccacagtgacttcctaagagtaatagttaccacttctgtgttctaactcttttcccatttcatctcttagccaatgctaatacagagcgatacatgaaaggggattctgagaaatgcagttgtctgcttaagcaagttgaccagcataatccagcacaacttctaaatctcagaagatagcaaatgtgggcagaaagaaaagtacagatgctccacgggttcactggtgatctttatggctgcaactgacctaggatttgggagatgcttggagagggacagaggggcacacaggaactttcctctcaaatatgaggatatcaatctagatctacgaggagtccttttggagataaaaagaaatttataggagatgatgaacaaaaggcccaatttctatattagactgtctccctgaatgagggtgaataccaagaggagactgagccaaggcctcagccctctgaattctaaaatgtagagaacttcattctgatctattttatacaaatggtgctggtctctcagacagtaccttttccgatgaaagaaagagagaaacgaagtagaagattcgtaacccagctcagtaaagaggcttacctttgctctttgctcaccatcattcccccgctcaaagtctcagctacctgcctctgtgcaatagctacacagtgctcctcaagtatctgcctcctgaacacagaattataactaacaagtatttaaaatttatgtatttggtgcacatctttcagtatgagctttttggcaccaactcttactgaatgccaatataaaagtaaacaatttgaaattattttaagtgattatcaaaaataacagcataaattctatgatgtggacttcagccacagtcccttccagggactcttccaggcagaccaaaagagaaaagctgtctgcaaaagaaactcaaagttcccaggaccaatagcatacttgagtcagatacagctccttaaaagacaagtaattttcagaggccctagggtaaactaaattagttttaacataatactatttaaacatgtagaaacataatatgatttataaactctatatgcttattgctcttatgccaacaatttaaaaatataaattaaacattcacaaagcttcaaaaccactacaacttcaataaataattttaatttaatgtaatgataatacttggctaaaactaaatcaccaggtttttttctttccaccttttatattaggtttaggtggtacaggtgcaggtttgtggaatgggtaaatatatgtcatgggggtttgacaagatacagattatttcgtcacccaagtaataagcatagtacccaataggtaatttttcaatcttcactctcctcctaccttccaccctcaactgggccctggtgtctattgttcccttctttgtgtccatgtgtactcaatgtttaactcccacttataagtaagaacatgcagcctttggttttctgttcctgcattaattcacttaggataagaacttccagctccatccatgttgctgcaaaggatgtgacttttttcttttttatggctgagtagtatttcatggtgtatatgtaccacattttctttatccagttcatcatttaagtcaccagttttgagtttaatagatgaaagatatatacgtggtgctgggttttgcttattaacttgattcttctcattttgtacataattttcatgcttgttttcctttgtttgaaacaaattcatattgaattgttaattaattcacttgatgggccaatcaatttactgtgcaccaatagtacaatactgaaagaaatatttttaacttttaatgaagcattctttactattgctaatcaactgtagtacagtgatttatacaaaagatgagctctacacagtacagccatgtgaatggggaatttagcaccaatcattcattgagttccccatgcttacagcatctaacttgttatgattctattttccaatgactgttttatattcaaattacttgacattattaggccttcacttagtattaaagtaactattagtattagcaaagcagggcatcaaaatattgtgacagtgtttgcttatagtttttcagccccaacgtgagttagttgtgttttatgaggggtatgtactccttataattttgcataatttaaggcttatgtttccgtggggaactggttcacagagcccaaatacctacaactttgtagcacatttctgttttgatgccgctctttattttcttagcattatctacaatatttagcaactgctcttttctaaattagtggtaaaacacatcaagggagttgtttggctttttctgtgggagtgaattatagctaacatctgtgaaaagttatgtatctgaatgcacattttccagcatgagctttagtaccaactcctaatgaatgctaatataaaaagaagtaaaacaatttgaaattatttaagtgattattaaacataatagcataaaataaccaagatctcttatagaaatgctcataaagcaacaggtggaacataccatactaacaatggctggttctttccattaaagctgaagtagctccaccatgtggcaggagtaaaaacaatctacgattcctttagcttgttcaccaactgaaattacgcaaatctcatttaagtttgatgagaaccacaaaattacccattcttctcagaatatatgggctattaatttttatatcacattacttaaatttcacataatttatgctgcccaactacatgttttagactaccattccattgaaaacacatttttaactccataaaattatgaagacccatgaaaattctagagatgcatatattccaagtataataaatatcacaaataacttttaaattcaatttttaaataattcttgttactattataatttccatacaggtctcagaagcatcttaaaagtaatgataactttttgtctctgtaaaaagaatactattcaaaaaaggacaaaaagttcataaatgtggaatactaactttgtaactaatatataaaatacatgagttttttgattcctaaattcttccaacagaaattcaaataatgtaaaatattggtatctttaagccgtaacttattaccttgttaatttcaaaacagcatactagtaacctgatctttaacattagttgttaccaaattatagtttttaaaaaatttcctaggaaagtacgccattttttgggtatcgaacatctcacctcataggaatacggggattgttttccttccactcttttgtattttccaaattttcaatgtaataagcacatattaattttatgatgaaatgaaatttgtaaaagaataaatgttaacattagaagataattaacaagttatctatctcgagtacaatatacaatacaaggaaattaatataccactttaccctggtggcaaggaaaataggtgagatatctttcccatcacaacataaaaatatatgttagtaaatattcatattggaaaggaatgtattctatgacctagcaattactgcgtcccagtcttggcattactcttattgtaaaagaaagcatgaacaagcagcaattttggggccataaaaagttggaaataacataatcatatagtaaaaagtgatatcacaggttataataagtctatgttccatatattaaaaataatgacacgaatctacatataatgaaaagagaagattgccaaaatgcattattgattgagaatgcaagttgcagaataatatatacagtattatgctatttatgttgataaaaatattgtacagtataaaccctaaatattgcacagcaaaaggactgtaagtacattgatgaattccctgttattagtacctgtggaagagggaattatattgtgggatgggagaacagtcagtggagagtttggttttaattgcaatgcttttatttttataataaggatgtattagcatattacttgcataattaaactttgttttttaggttttcttcttcaccatcgtatatttgcatgcatatacctatgcaaataacaaagtccacctttattggggatttgtgactggcatttttctaagcactttgtcatgtgtcatatattgtatcatgtaaacttattattaaccttatgatgctaataatatttttcccatttcacagatgacgaaaccaagcctcagaggaactgagtacattgcccaaattcaccaagcccgtaagggttacaatcaaactttgaatccagatatctgtctcagagtccacaatcttaaccaaaattttttttacaaattcccatgtagaagtgtgtacatccacatacagacgtacacacacacacatccctgctgtccagccttttctccccctgacacttgagtgcacaggtcattggcatcttctctccataactttccaccattgacagaaatgtgtttgctcaagggatgaattgaggtgaaaaccttacaacattagctcttttgtaaaaaatctgagcagattttttattttgtattttgttttcctggttacgcctctccttttaaagttttgaaaggtggcattaatatctatttctttcctgactgctccatttattagtttcattaggattagtgaattctacttggtctttccccaatccattaatattttttcccttcacttaaaaacaaacaaacaaaaaaaaaaaacacttgttttccaaatggctttggggtggtagtaggatttcctgatggctagaggaaactcctcatggcagtatcttggttgagtaattggtcctcgtctgtatgttcaagaaggtgaatgttcttagtaaacccagaggggatcagcccatcagaggtaagcttctgctatgtaaattgagacgagattcaggcttaacctcaaataccaatgcatttgctcttctggtctctcccttctcctccttattatcatgatactttaaaagccaaattactgataagaaatttgcttgctgagaacatagaaaggtaaacggctcgagagagggggttgtacatttttctttaaatctaaaaaaccactatgaagaatcccaacctcccaacaaaaattgcctctctgttaactggattttacctgcatccagttttaacacctctctcctctggacagtgctgacactgtcctcctgggaattatgacttccttagacacataatgctagagtcaagttggaacttagattctttttcttgcggaagtgggaggcattgtgtcttctcccttcatgcattaatttaattagaaaaacattcactgtctctcactatcagcctacagattctctatcttctcagcccggtaagagccttatcacactgagataaatggttctctttgttgtaccaaggtggttcctgaagcatggtaatggggaggagacacctagagatcaaagcaactaatacaatcaactccaatccagccccaaaccaagtctttccaccagctattcctttcatatctaaatgttgtcctcttcctctgcagcaggatagaaaatcaatttctaagtgtaaaggcagtaaacaaaatttcagagatatatagtatatgtaagtttgagtgcataaagttaaaagattcccaaatatctaaaaatgtttgaattaaaaaatcagtatcaaattagtaaaaaaaaaaaaaattaaaaaggtatgtgagctgtataacagtcaaatgttaatatgcttaatatattaaaagtgtatataaaaggataaggacaacactagcctgatggatatataggcaaaattcggatacaaaaattgtgtataaattactaatgaatatttgaaaaaaaacactgaaaattttaaaatgcaatgaagacagctataattcatatcaagttaacaactatttttaaacaatcacaatctaatgctgatgaaattcggcatattaagagcaattacatttttactgctatgattgcaaattgatacagtataacagtagattatttggcattaggtatcaacagcttttaaaatagtcatcctcttgacccaaatattggaaatctatcattaaaagggtcttctgagcagattttatataagcaaaatgttcattaaatatttttcatactttcacgtaatttgaaataacataactatccaacactagagaaacagttaagcaaattgagcaacatctacccagtagaatactatgccaccattaaaaattagattttcaagagttttaaattacatgggggaaaataaagttaacagaaaattgaatgtacaaaacggcctcaacaatgtcagaaaatatacttaagaccaaagactaaaaggaaatatgccaaaatgatgtagttattgtctctgggtagtgagataatagattatttccttcttcctcttctttttataattgtatgtaaaccacaatttcttcttcaatgaaaacatatttttataatgagaaaaaatgatctaataacagtatcttttaaatacaaggttatgtgccctgaaaacattcctagtttcccttaaagtcatttgtctaacataagtgaatttgtctgaatctctctagaatacacattcatatgctctaccccaggagcaaggagttcctaaaatctactccctactatgtaaaataaaactgcctttaattttttcctgaatttgtttcagacttcaagtagagttctttattatttctgttcaacagcacaaactacaaacataatctgtttggcaaaccatttttattcaaaagtataataatgccttgtttttcatccttccagaggacctagtggaagaaaatgcctaacatcagggaacagtaggagcagcctaaattgaccacagaattgtatttggccactgtcctcaaaaaattcaagtggattcagtaatcctgaatacttatgtacaacaagcattcctactataatagatcatgaggattaaaatgaggtgagttcattggtgagcatgacatgtagccatagcaattaatcttaggttccttctcccttaaaaatggctaataaaacagaagaaatgctgtatgaataatttcagaataacatggaataattgtagatatttctataagatttgtaccagatccactagaacaaatctaccagtagctaaacactgtagagtctctaaaaatggacaaggaggagatgtgacaaagatactctttaggggaataaagtcatcctaaaaactgaagatattttctgctctgccaatcaaggaatcactgttctttccccagcaagaaggagagtgaaaagaggaccaaattggaggccccaaatttgcattttaatcataacctttcatagctaattatgagatttgagcattctctggatctcagtttgccacccataaaatgatgggtggactgaaagatttctaagttttccagttctgacattgcatgggtctataaggagctccatcttggttggcccctgaaggcacctggagactttggttttagggaaccaaggagtctcagtgctgaatgaggatatagttccccggtgtagaattttagaaactatgcaagcacttggatctttaaaaaaaaaatagttggtccctgggctgtctcttacaactttaatatttacactatgacaaagtgaaagtgctcattcgtgttcgagccaaagtaataccattctctttattcattccaatgagctaattttacatgagcaagaaagcactggagaggtacagacccatgggatatttgcctagcctaagtgagtctcagatggaaataaatatgaaaagcgttagcatgggacctgtgagaaattgattcttacatctggcctccaaagggtcaagccacaaataagtgacctttgacatgccccttctctagttcagcctggagctgcccacatttcccagtggtgcccagtcaactcattctcctgatgcaggatcatcagagagaatctggagtaatggcagctgcgggtaaggggctgccaaataatagtggaacaaagatctcttccaagtttctatttcctccgaatagctcaaatacttcaacagtccaggtccccctaaagactgcattttcttagctgcattctctctagttgtgatgagtgtctcaaaaaggaacacctctcctcctgagtttatgatagtttatgacctgccacttcatttccagcagtgtgtcccagttcctcttgcaatccacaaaggacactttttctttcagtagcctggtgtgagctcttgcctctcaggattagctgtgatcttactgctggggtgggagcacacttagccacagggcccaaaagaactactgtcactgaaaagagcactttcctgtatttgagggctcttcctctcttctggtacacccggggaaaaacctggcagagtccacccacagtctttgaggattaattctgtaagaacttcttacactgaagggaatcctcctccaggggatgattctgctctgtgcttctgagctctgatggcaatcacatcaacatcgccagggactgtggcagaagaggaacatcacccactggaaaccggggcaagttgctcctctgtagttccaggaaatggccagaggcacagctctgctgttccaatttgcagttttctctaacatcaaaaataaaatgtgatttgcatttgaaattttacagaattcctcattttaggtcaagactggccttacccataggttagtgacttatgtggtaggatttaacacacacacacacatacacacacaaatattatccataaaaagaattatattcccaccaacctgctgtggcattcatcagtgaccctttgaagttcagccattgaaggggcaggttaaaatgcaaatttgtttcttggagaggtagcacatagagctattatcaactgtcaatgctccggtattgctggaatgtcagactaagaagtttgggttaaaaattaacatatcagtaagtgaagactggctttatatattacatatttaatttataaaaatggtgacattaaaaggtggcaccaaaatgtaaatagaatcaagatcactttggataaattaacgcatgacacaagcctttgacatgttattaatggaaatgagtttgggggatctaatttagcctttgagattagtgtcaacaaagaaaggtatctcctctggtgcccatggcagaagcagaacattagtacaattcaccatagatcagtttcactttgtaattcagtgtaagtggtttatatgatagagagggcaggaagatctggttttgactctgtctctactacttacaagatgcgtgaagctgctcaagtcacttaagcaaggtgagcctcaggttcttcatctacaaaagtgggatgtagaaaagaagagtaaatgtaaaattcctgttcagtagttgtctattaaagaatctctccttccttcctctattcacatccatcagggagaggagtaggctgatggtgccagctaaggacctcggcactcctagacctattcctgaaccattaatggctctgaatttgggacaggaatgttactctcatggttaattccttgctcacttgtctgctggtgcttgttcacaatgtcaaagatatggcaacttcatgggaaggcaggtttaactttttggtgtttttgcactagcctgtatatctgtctacctttcatatgagaaccaccttgctgattcagactggaagcttcaagagagaagtttctttccatttaatgcactggggatggtgctcaacagagaaccacactcaaatcggggctaaataatatggcaatatcatggttacaaaagaaacacctccctttctcaccaaatcactgaatcccttattctataaaaatgaaattgaactgcaaacatcaccaccatgacaagaggatttaggcacactgatcaactgattaaattctatttgtcatccagagtgatcctggaggccttcagagcctggaggaaacctctctgtgactctactcacatctttacacacggaaaatccaattaggctgagtatctacagcagcttccagaagtaaactgattgcagaagggcagcctgctgcctgaggactgcaggggacgaggaaggggtgggccacctggaagggacctctgccttctcagcacctagagttggtttccagatgatcacatagtttaacccttttcttttatagacaaggaaattgaggcccagaaaggttaacagtcttgcccaagacctaagattagaaggcagagttggggttgagaattgcttatgtgagactcagacccaaagcagacgaccatattttcaaattcagtgaaaactggaaaactcgtatgggcctacccagcctggaaaatccccatgtattaccaatacatagtaaacgaatcaaagattgaaaagtttacttgaaaaccaatcagaagtcctctcccacatgcaaaaatcccaccctaatagaacactcatcacccgtcagactgtcttaacacttcttcctttttctttctttgcaaacccctttgagcctgtgccagaagtgacggtgtctgccaccctctctgcagtcagtcctgaccagttctctggggtttacacctgtcctctggccactcgtctgctgcacttcctgcatctgcttgtttcaccttggccccagctttacctgaggggtgcttggcctgtgccttgagttccagggcctatgtttacttcaaaaatattaatgtcaattccttcaacttgttccaaagacaacagagcctctcacaagcaggcaagccctgccacttgttacgtagttgaggctgacgagcctgcaggtcccagccaactttatcacctccctcttctgaggggtggaagtccccaacatctcagggtcccctgagagtatggggattcccacatcggcaagtacctgcttcagagaagcccatgagaaactggcccagagcaagcgggtccaccctcccattgtgggaaagtgaagggcagaaggagtctggctggaggtcactcctgccactgatcttcctcactcgggtccagcctgtcagaggataaagcacagtggtgggtgggggtatctggctctcccccaccctccttctcaggggttcagtagtccctgggaacaagattcagctcaggaatttctgggatgctggtcagttctggccctaaggacactgggagtgacagcgggctgctaaggatgtgacagtgactgggctgttcccttcacatgactaccagggcaagccctggccaaatcccagcacctgctgaaagttgaagctgaccactggagtgattagattcatgacatgtggtggaggcctggggagtggagctactgggaaaggacacagctaaggaatctcctccctcccagcattgcttgaccctttcacaaagacagtggtaggtagaggaagaaggagaattggcctactccttccttttcgctgtatatggtcatagaaattgtcagaactttatatctagattcaagttctatctctagcacaattagctctaaaactttgcgaacgttacttaacctcctaggtcctctttgttcataaaacgagaacgtaatacataccttggttggctgtgaaagttatatgagtcagtgttgtggggaagttgaaggcatgcagtagatgcacaaggaaaattaaattccgttccccagttcctggcttgcaagttgggggttaaactcagttaagctcagagaagacatgacatgacgggggatcaagggagatgtgggaagctcacgggctgtggttcccactgatccacattagactccaaatgacaacaccctcacaatcccatgaaattgagcagaatttctcttctttcttgtgatgtttccagaaatgaagagagagggaaggaagacacagactctgatctttggcttcactttggttccaagacctggagctgatagtgtatggagggttgcctgtttgtccaggcactatgaataagaccaaggtaatccagcccaactctacgacacagctaagccaacaagcagctggatcttgtgtctcagcactcacagaaatgtataaatcatctgataccaactgctccccggaagcctctgtctccagaatataaatgtccaactacaggactggcaaagaaaccaagccctgggcaatgcctactatggacccttatttcttgtggtttgctaagaaaaaagtaggcccaagggagaggagggggaaaaccaggagggtctaaagttcttctgactgaaagaaaagaccacatcagagagaaagaaaggaatcagttaagtaataaaaggttgtgagttgatttatcattcaactaaacaaattatcttcctacacaaacattctgaggattaagtgaacaatataatacttttctgagctctttttgatcaaatgctttgctgttaaaggttatattcctagggagttgatactgaagcttcttgttccttgtcagtaaacacaaggagaggccaaccctctgtaaatttaaattacataaaacctttccccaaactgtctggtctcctaacagccccttttcactgaactctgtggttatggaatgtaagtatctttatcacagcagcacagacttttgaaaatttgacataatagaatttcttcctcacaaggcatatcaaacaccattgcaaactagtgggatttttaatcaagactaaagcagaggtcttttatttgtttgtttgtgcttagattatttccacatgaccaataaaatgttctctctgaccatcatccctgctgactagaagtaccaggaaccttgtctcaccctcacctccagaggtaagggtatgaacggactgtgaaaaaacacagcagaacactggggtcagcagagagaaagcgaaagaaccccatgggcagataatctaaaagcagcagagaatcaacgggaaactaacacaagtgcctgaagatggagacagcaatttttagtgattttggcttgtctctgttctatgaagctccaactcagtggcaacctagtgtgaaaatttatgaaatacttttggatttatctctgtaattccaggtctggcacaatataggtttcttgaatgaataaatggatgaacatgtcaatcaatgaatgaacagtaatattaaggaggggaagaaaaccattacaggtcaatgaatgggttcctagaagattcccctgtctcccattgtcttccgactcagggagacaacagctggagcagagtgcctagacttcgggggcttaggaggccacacatcttagagagcatttcaccatcaactgcaattcctttggcagtttgaattataatatttacttccatgatacagtcttcagctgttgtaactgctagtgacccttctctgaatccctacttcgtatgttagacattttttatatggagaattaatacagccttgactgctatgcttcttttttacttccatctctaataataagatcctcaagggtcgagactgtcatactcttgttttttgtgtttacttcactgcatatcctagagctgagtacatatggaagaatgaatcaattaatgaaatttatgaacacatgctgaggtttaaagagaatatcaactgcttggtttgatgacaaaaagcaacatcactctgtgtctagcacgtagcccagaggtgcgggccccatcctctcgtgtgaggagcccacggtgatgcataggcacctgcaccccgtgcctaaaccctgcagctggcacgggccctgtctgctcttcattcaccgttctcacgagttgcaataagttcagccctccatgtcacactgtgttttccatcctggggagtgtttcacagctatcccaagccccacgctgacgaatcacggccgaaaacacactctgatgccagcacagaccacggagcaaatgtcagacaagatcagcctcggaaaagtgagtcctgaattgcgatggaagtgggcttcctctcacaaggactttgtgtggagatgcgcaggtgggctgttggaaaagacccatggaattcccttcctctgggtgccttttctgtcccaacctctggggattcctcaagaatcggggggatttcagcacggagtgtgggactctgtctgccccaagatcagaggattcaccttgccttttggaaagaactgcccagtgtatcaggtttttatgagtcagttttagagttgggaatgcggacagatttgtaagaaagtccacagagcatatctctccacagcggagaaggctctcgagccccagaaggcaatatcacggtggcctaggtggatgtcacggggtgagaatcaaccctcagttgccacgaggaatctgaggagatccaggattacggtttttatgtaactgtcttacctctgtttcacaagggccaaaacttcagccccgttataaaatcaacagatgcagaaaagagacaagtggccactagatggcagcagatggtaagaaacgtgagttgcaggcgggctgggcaagagttaggctggaagcccctccattttgctttacatctttaatgagatatgtgaagaaaattagtcccttacatgccagacgcagatgccacagcatatggagagatgccgcacagcaatatttctctggttattaaacaggaggcacctaaccagtcattcactgcatcatcatgcagagttatcctttaggtctccggatactgttgttgacaaggtaataacagaagaaagcagttgagaagactgatgtcgggacgtgggcctctgggctcgtgggacttcaccatgccaggggatggggcacattgccagaaaatgaggagcagcccactggggccacttttccgtggccagggggacactgtggcttctgctgccgggcttagtcccagcaggcgtctgctgctctctggtccccctggcagccctcgggggctcatttattcagaagccccattaccgcgagacaattctgcggtctgacctttcaccacaaatcccaaatgggaaagggagctctgggaattttaaagagcaaaccacacttgcttctccagcaaaattgaaaagatacagcataactagagtgcattcaggtgcacatagatagggaaacacggtttccatgctgccccaaacaaaaggagggagtccagtcctgccgactgcaggaaacagcctcactcggaagacacactttttcttgggagagtgttcccaggtccagagcaggcagggattgcgcccacttccccacttctcacacttttctccaaccccaccactcagtctgactattcctttatttaattcttccacactcccaaacccaggggcttcataaggccttcagggtagctgaggaacagagaacagattattcagtccaggcaactagtccttgtctcaggcccaacaagaaactgttatcttattaacctgaaagcccagaactctcaggacttctcagagtcactcatgaagccccttaacagtcctgaaatgaagataaataatacagccatttttcgtacagagaaactgaggtataaaactgagatcagctgcagctctcctggtccccattgctttcccacagattcaaccctctgaagcatcctccagtgaaaatgtagtagcaagattcaccctaccaggatttctctccccctcttagaaaattacttcctgcgctagaaatcctcacttgtctgtgtgactttagacaacttgcttaacctctctgtgcctcacttatcatctgtaatttgagggactagaaccagatgatgactaaggcccattccagctcacagtcttgtggctaatttcccagtcctctgccagccctcaaagagagttgtatgggacactttttccagcaacagccaaactcaacaggagcaagcagaatttccttctccaattgagaagcaatggggtggtggttggagtcttgttgatgtcctttgtcctcggagtgaggcaaacagtgaggcttcagatgttattggcactaacagcagggcctggaggtggccacactcttgtggaaggaccatgcagagctgtccctgtgggcagtgtaggtgcatagccaagactgagggatgttttaataactacttctcaataagaagtcctattttattctgcacaggggtgtggacccaatccaggtctcccaggaggaatctactctcacccataataggggattggttcagctcagctgcgctcacaaagggctatacagcatgcagcagtacaggcagctccccgcagctccatgtgaaaatgactcacagcagttatgaacatcaaacctcctttgatgtgttcccagacatgaagaacagccacgggaggaggagacggactctggttgctagctctgtggggtggcgcacagagggcctggacacatctggtaccatcctgaagctccaggagaaattcaggctgggtaattacctaggacttcctaggataacagagcttctttcatctatctctctccctccctctcactgtctttctgtctccagctacaagggaattagattctccaaggaattacaacctgtttctgtaccttcacctttcccgaggagataacaattcacatccctgaataaaagttgttttattgagcacaaaatgaatgcacccccctcgctcagcatctgtgccaattgccttaaagctatagacctggcctccatcagccaagtgaaaggattttcctctgtcatggccatttccagactctcagccttttgagtagccacatggtaccttgtcctcctaataggctctcaatgatgattgaatacaaaggctctaattctctgttgcattggcagctcccaagactgggtcgatcacaatcgtccacagcagaagacagcggtgctgacggtcaaatgagcatcagggcacacagcagaaggggagggtcagccactgtcccttcatgcccatttcaacagaaagcttatttatatgcaagaggtgttccccttccagacagggttcaagagcacattggtccctggaaacttgagcaaagtcttcacggttatagaagggagtggcaaaggacatgtaggagagaatcagttccaccccatgcctgcacatttcattttctgaaatgaaaagctctcatacactcacagagatctgcacatacccacacatggaaatagcataaacagctactctttactgagcagtgaccacgtgtcaggcacaatgcctcgggcttcacatgcatcatctctaatcctcatcgacgttctgggtgtgggagtgaaggcatccctgttttatggatgaggaacctaaggtcagaaaggctaagaaactttcttaagattgaacaactatggtagaagagctacaattctagatggttggattccaaagcatcatctcttaaccactgtactatggggcaatatgcttataagcaagtgcttactctgttggaggcactggggttatgagatagtgcaggaaagacatagttattcacttcgcaaagcttcatttttaccgcacactcatgcacacagtgctacacacacacatgcagagttactataactgtggtgtcttccaagagccctgtcactaaggtatcctcagtgtcgtactctcagtcctcctgcacttgaaccacagtttgaattgtgcatagggtaaagactgaggtcttctacagaaaggcctaagctgcttgaactttacagacaattatgtgagcaattcaaccttttatacattatgctgtagttacccagctcctgaactagtcatcaggtattttatttgttttttaacgtgatcaggaagtttctctgactcatttctctatctttgcagaggaacaaggtaggagagcaacaggggcaggaacagagaggatttcaagcttgatgaaggttcagtaagtcaagtcataggtcaactagaagaaataaagcaggggaagatttggggtggggctgaagctccattgtttccatgacaccataagataagtggtgatctaggtgatctaggtgtgcaaaggtgaaacaaaacgaaagacgcaaacattgtactagtttcaggttttgccaagagcagattggctgccaaggctacttcagccttgactcatatagatccatgatctgggaggcaagacagcgtcctgctgtgctggacatctcagtgacattgacccaactgggggaactccctgaggttaagaaaacctccctccaaggctgagttaatgaactacctagatgtaagacaggagactgaaaacatttaagtcccaggaaaaatgcagacttaccttcttatgacctagatctctttgcaaatctaatgaaaaaggtttgttatgcacaaatgtttccctccaattttatttcaggagatttgtgctctttcctggactgcccctgaacctggaggtaataattctagatcaaagtctccctagaaccttgaaaagggtggactgagaagactggatatacagctctaggcaaccagtcctccactgccaccaccatgctttctaatctccaggggagcctggtcatcttgctggacaattgctgtttctcctgacaaaatccaagttaggaaactgacagggtctttgtttctatttctctctatgcctatctctcaaggtgccctgtcattaatgaatcttaatcctcacttttatttctcaactctggctcccaatttctgttttcccacccctcatctgggggagccacccggaaccccctcattaatccacagacagccatctcaggacttcatgctaagaattcattgtttcccactttcctgcatttgaacactggagggcaatgctggaccagccaaagcactctaggtgctccgctccatctttgtctcaaccttgcctgtcatttcaggaagcagcctctggttggaagccaaaaccaaggaccagtggagcgcccataggctagcagaacagctaggtctattacagcatctcccccacacgggatcataggaataaaaggtagctcacggaaaagcacatctggtttcatgggtgacacaatcccctgggaaagaaactgagcggggtgcttgcctaactgtgtcattaaccagaaacaatctgtgtctctgactaggggatgcagattcctacctgtcttcactcactcagatgtaagcccctggagggtaatgtcttagtaaggtctgcattcctgtagcaagcacagtgtttggcaacaaatacttgctggatgaataaatggatgaatgcgtgtatggatacatatgtataaaatggaactggccattttcagatttgttgttgttttctagctcttatgacacccaaagtttaaatcattaatcagttgctgagcattcttagtcttaaagacaactaaggatggtcaggtggttaattaaatcagtggttgtcattgtacaaatgttatttcaaacaccacttcaagagtttcaggtctcttatttttaggaagtccttcattgtgtcatccatgtgtcctcagacctcaccagcctgtggattacaaaatacagacactatttcattaatattcaatttacaagaacctgcgggctcatcatgtggaatattgagtatccgtgatgtccccaagtgatttgtgggcatttcatgtgccacagtgggtccccacggggcttgacagttccatggagccagagctcttcttcaggccatctttcatcatcttgtgagacttttctccaggctgctctcccctctaccttcaccacaatggatcccatgtcaggtggacatggtctactctcttaatcattcaaagcactgctaaatgtttgaggaagaaagaagagcacattttgagacccaaaacccaacttgagactctttctacctccaggcaggcttacgcatagcaaagaccagctcaaggcgcccggtagaagtctgcaggcatctccatatctccaagtgcagagagcagaggagattttttcttctcagtccaagactagttcttttcctgccctgggatgattgacagtgagaaaaaacatttcctccagggaagcgctctacctgcccctccaccttctcagacggggcccgaccttcatgaccccgacaaagcaaacctggtgctcaactgtcttattagatcttctaacactatgtgtgtgacatcaacagccctaactaaattcacacttgggaaaaatatgcccctcattctaactaaacagacaccatttaattttcctaacagaacacttactattttgatgcacgacacctgttttcagttttatgataacttcataatctccaatacaatgagtgagtgtttatttgaaatgagaataacctcattctcaactagttttctcaacagaagaagagtgctcaaagttcatctagggtctttacctacagaaattcaatgctgtcagcaatcttcaaggagcagctctgccaaaggaaaaagaaagaaagaaaaaaggaaatcctgcttttataagttatccctattattaaaatttctaacaaatctctccctacagttcaaacctaggtccccagagtatatgggcctcatccttctcataaaaatgctgttaaaaaaaaaaggtgtcctttgacacctttcctgagtgcaaacagagattgaaaaaaatcattctaaaataacatttttctgtcactgcccaatgggaggtgagttgatcataggtgaagcatgtcctattagtatgtcttgctcaggatgcctttggtgtgagtaagggatgggtttctagggcaaaatctctgttctatacccgcaaaaaacaatgtacagaaatttccctaagagaggagattggcagtcaatacataagactccataggcaggaagtgtccagggtcagctccctgcattcaaatacagacctgcatcagggctgtgatttccaggtccaaggctcggtgagtggataatacctaaggcctgatgccaggcctgatgtccaggtttaacactgatggcaggccacagaccctcctgtcttgggattccaaaaagcccagaatctttcccagttcctactgacactaacttttgcccgggcaagaagtgtctgagattgcttcccttgagaccatagtcctttcttataattccaaaactaagcagccctgtttatgctgctgtggcagagcatggaatcttggttagtccttccaaactgcacccattgggttatccctggggaaatgatcacattacgctactttgttgaacactgaggactccaataaggactgtgaatcccaactatttctggtgtgggagccagggctttcaggtcattcaccagaaattatccaaccagaaaactttctttcaagttctgttcaaagtccagcagtttgcctacaggattcagatgagacttctaagaatcatctgtgtcttggatagagcaccctggcagcctcttgaaaatcaattccctaagaaacctatcttttagaaatggaccttcacaaagccagtgagagaatgggaggagtatgtggtttccaatgggagacatatatagacttttatgtcatgaatttctgaagtcagaccgtgacaaatgttggtcagagtacaatgcacagttgcccaaaggaggggaaattagcttggttcaggaggactaggaaatcctccccatggaagttttagttaaagtgacttaaaggatgaatgattttgacaaatgagggattggagaaggacatggcgggcagagggagtacagcttgagcaatgtccaggagggatatagaactgtgcttggggaacagtgatcacttggtgagagttgagtctgcctgagttggggcagtggagtggtgggagtggtgggctgtggcttgactgagaaagcttttgtgaatcacattaagggactagattctgttatatgggaaatgggcagaaatcacaggcatataagaggaaatgtgcttcaaagagtgcttggaaagattactatgggtgggaagactggttccaagaccggaaacaatgagatcagatgtaaagttaatatgaaactgaggtagacattgagaaggatcagaaggacttggaaagagaaaacagatttaagaaacacctcaaaaatagataaatgatatgtgggaatgaaagaaaagggagagattgtctcttcccgacatcctggctatgtactggaagattccctagttcccaagccccaaggtcttaccattagaaatcagtccttactcatttgtccattaaggcttaaggtgtcaatccttccaggaatgcttttatgtttctatggtccaaaggcttaatctccagtggcagaatgccaggtaccaatagaggagatttgggggcagtggtcttctcgggaccctcaaaaatcattacatagttgcccactcctcttatttataaagctgttcgtgtgaataagcacccaactactttgtctgtgcccatttgatcactgattgaataagaaataaaagccaaacatctatattctttttcttctctgaataatcttttcccctgtcttcagatttggaacaaggaaacccagatccagggaaaatattctaaatccttgacctccctatccagttggcaccccagcccagtaaaatggcttcaagtacaacattcccccaacagcaaagacagccttcctgggagtcttgggtaggcctgtccagggccaccgtgcagcacacatacatcttcccaaccagctccactgtcacaaacaccatccacactgccatgggcaagcctctggccaccaatgccaccccacctgctctggtgtgggcacacctacagccatgccaccaacactcctcgtgcacatgtctatggtgtatctgtgcagtcacagttgtcaccagctcaattctgtgtaaccctaagtccaggcatcttggggtgaatgtctccttattcctttgtccattgtcctgctctccctttaaaattgttcatgagtgtattttgcagaaagatatgtgatcttgaaagacagagaaggaaagagatgaagtaggagagtggcaggggtgggggtacagattttgagaaaggcaagaaaaaagaaaggatccttgacctccatcagtcccaactcccaaaataagactggccctaaagatagcttattatttatcccaaattaaaattttatggctctgcaatcattgtgtacacagtgaaaagaaaaccatcacacaaaagatgcagttatcctcacagtgggaacaatagcagccaagctgattctgctccaagaatagaataacagtgctaagtcaggaactccaaaactttgtcaacaaatagaataatttcttggtgggaaaatggctatgaaagaaggtgggcaggaaagcaaccttctgactcttgaacttggcatgggttgccagggaaaattccagccttggtccctccatagtgagctcacaaccagctctgctgactggggaaaagtcctgcctgaatatgcacagactccagaaggccctcaccttacccttgcccagaatcatatacagaatctaacaggctgtacctgcttctcttgcctaaagttatgcatcattaccagatttccagctccatgatggcagaaatttcagctgatttttttttccattgtatcctcagcattcagcagaaggtttgtatatacttggcactcaataaacacttgctgaatgaacggttgattgattaatcaattaattgattaatttaaaatgagcaaaatactttctccctgtctggcttctgaagagtgagtctgagtactagaaactgtcagataggcaatagaagccacagtccacttggaaaaatgactgtttctacctttgctcatccttctgggcatcttagattcctgaaattcaggaacaaggacccaagagatcatgacccaccaagtgtctttcaacaaaagactattttcctggctgtttcctttcagagaataagcctcctggggctgataagcgaatggcaccatatgctgaaaacacaggccctgagtggcagagggcaccagagcctcctctgaggagcctgttggattgcagcctttcaacaaatctgagtgtgtcttttgatagcatcagcatcaaccacccccaaggacctctttcttttattgcttcagcaatgaagcagccacatggctgttgtagataaggtggcccaagtgcattgtgcatgcaatgtaggctgctggtgcacagcactgagaatcgcagacacgccgtgtaccagcttctctacactgcgttgcccttcctctgtaagtggcccccaggtaaacgggtgtgattccccaccacttctcatttctcattttctatcatttttttctttgccagatggctcctgcaagactgaaatcacacagccttccaacatggccacaatgattgggacagatgtcaagttccaacgctaatataacattcctgatgggaattatgattctttgtgctggcatctgcaaagagctaaccaaaggtttacctatatctgctatcctttcaaggcaccctggaatcagagcactgctagttgtctgtggacagaaaattgttctccagaacccgaatccttaagcatgtgcagccaagagactgagccatttactgctgtgcactgtgggcaccatgatgcatgctggatatcacactgaacaaacactgtaagcctcaagcagcctcaacacagaaaattcaaaagatccaccaacaacacacagggtgtttagtgtcatcttaaacttgcatcttgaatgcatcatcgattcattcattccaaactaaaagtcccttaaggctttcaaattgatgtactgagtattgtgaaggataccaacatatataacaaacacttctcaaataataaaatgtattcagcaggtacaatctcctcacttttatgttgctaaaccatgagaaattaaaattaaatcctgtataattacttgaatcttccagctgacaaataaaagtagtctttgatacacagaaggacaaatgaattgcacacacatacaaaattaaggccagcaattaacatcttaatgacatacccttaacttaccaacatttctaaaagcctgaaaaaatattaaatatctatgtatacatgatatgtacagtaaatttatagatagatgatagatgaatggatacatagacaggcaagctgtaagaagcatcataaaaggactgagctcaagttcagactttaaagccagacttcttgagttttgaattccagaccttccatttactgactcaatagctatgtgaccttgggcaatttactttttgccttgctttcctcatctataaaataatgattacaataacacctacctcaggggattgttgcaggaattaagtgacctatagcacatgttactgtattcagagcaaagcttggaacatgaaaagcactcagtgagtattaactacttttgcttttgagtgtgataatatcctgaggatgattactaaatttcccctgtgttgggctgggttgagcctttaggaagttgttgataagaaatgtcagtctcttgaacaattaaacattattttctacattagtatcctatctagtaagaagtaaatatcaatggaaattcagagaaatacaattcaaaaggccttcaggacctttttcctggatggcaataaattattgagggcttcctatgtagaaaaaaaaaaaacagaggaaagtaatttctgcttgaccatcataaaataagcaaatataggctttgcgagatattaaaatacaacagtaaccccactcattaaatgaatagaatagtggaataatgtataaatttaaagccaaaagtaaaattaaagttgtttatgcacatatttttgaagtaaaatatttgttctatcaacataaaaggcatagtagatgacctgaaaaagtttccacctccaagaagataacaaatcaagtcaaagtcacagtatgcctgacgttgtgtcatcctcaaaaactgggaagtcaggatcagtccaagactccagaagtgaggaggctctaaaagacacctccacttcagcctctgcttattcaaggccccagccatggaaactcgatggtgtgaactgctgagctgagaactgggggtaagtgaggactgtcttctctgttttcttttctgaagacgcagggtctcctgctaattcggattctgtgttttattcattagtgggaacacaaatcccctgctatcttgctagctttctcatttgcagccaacatatgggtttatcagcacggttagccccccaagaacagcccttcagggacatgggataacacaaaatgggaaattcttcttggaataaagagttggggaaggatcctttgtaaaatttggttttggggtcagatttcaaagtcttaaccctcatgggacaggcagagactcggggatatttggtgagtgactgagtccctattcctcctgagcttgcccttccccagggcacctcagagccagaactgctgaatgttaacatggggcactcaggtttcctacaggacacttacaactctggtaaccctgctgtatactctgccagtaaggaactacttagtaattcctccgagagccaacattcaaagactaatgccacgtcacatgcaatagggaaatgcagctctatctgtcattcacatctctgattctgtcattcattactccatgctaaaagtcccagtgggagaaattgtctttcttctttttcaaaaccagcttctactgaaggtaaagaaaagtttaggggtagaagaacaaagtcattacagaaccatgcattgattggtgagcactgcccaggggcaggttttgtggtaatgatccataagaagcaaagcaaaaattatggtggagtcgatggaatatttgagagtctctgccccaaccatctcataatcgaactgggagccctccaatctccccatgcaagccttggaggacagtcatagaagaaaaagtgagcaagaaggtttaactagctaacaagtgttcatcaagtatccataaatctcagggtacagaagtggcatttttgtattcaatcatgtatatattagtgtttgctatgtgctgtatcccatgccaagatccaagccttcttccactgtgtaactcataccgtagcagggcttacagtctaatagaggacccaaatcagatgcttgtggaaacaagagaaatacttggttgtaataattatgggggtgttccaggaggaaagtacagattgaaattagaatatttcaatttcaggatgagttaggtgatgggagccaagaagacatgctaaaggaattaaatcctgagctgagactagatatgaaaaagtttgtttatttacatcccaagttcccaagtcagtaacagaagcagaattacaactcgagaaaggccccacttgcttctatgctgttttgctcagcagctgcttcctttggtggcacacagctgggaaagtgagtcacagatggactattggcagccaaaatttttttagagacaaatgacactgtgatttttcctgacacccattgaaattcctcactaatttccaaaaatatcttatgttgttttaaaacatccagtgaggcccagacatttcagtagaacaaatcagagaaacaaagttaattccagccatctgagcattctgagcccaaatcagctagactgagaagaagaatcgtttacttaccgaaggcagtcccaggacacccagcagctaaggtcctgactcacagcattctaaccaagagaaaacacaaacacagcatcttctcttttcattcacttctgttcctgttcttcagttgcttgtccaaccagctggagacacagcagagaaaccataaagcaaagaaagcaattaggaacaggagaaacagctgataagcactctgcctaggtagaggtgaatcctgggcacccatcagggaaagactttgccattactaaggctttaggtgaggagtttgagggttacgaataagagataaagcaaggaaagggcttttctttgccaaatttatctttttttcacccataaaactcaaagaggatagggaaagaatgaatgtattctcaaatcaaaggaaaaatagttctaaaacttccaatgagtgagaaaatcagaagttctggcactgactcccatttatattgaagtaatactatgggtaaatattttatatcaaagaccccagagtggcagagaccatcagagaatggcattaaactgggcacgcatagtagccgatatggggttaatttgatttgaccttggcatcttttctcttcttaaagtcctcccatcctttctttatcctgtatagacaaagaagactggggtctaacttttatgtgtcttccatcctaagctgccagagacagtcctttgccaaagggcacagtagattgatactgcccatatgtctctgacacggctccactcagctcattcatttatctacccaagtcctacggcagcctaacatggctcaacagactgctgtttccctcagaggaatgttctgtgccagccttgaaataacaagttctgtgtctctcctggtaactatggctcaggcagggggctatgaccaggtcactaaccccaccatggcaaagaagaaaagacaaggcaaagaagccaatatctgtggagggcttacaaatgagtacctggcacaggaataagcccttcacaagtgttctctcatttcaacctcacagcatccctgcaaggtaactataattaccccatttgcaaataaggaaatcaagactcagagttgtaatttgtcccgctactggtaagtcacaaagcaagattcaaaaccatgggctagtagacctgcaaagtcagtgctccatttacatgtaggtaatatgggcactgataccacctaggcagtgagccacaagctattacaagcaggttctatccaagtgggaggcaccttgctctaggtacctagcaggttctatccaagtgggaggtaccacctgctgcagagtgccccacttctccctgcacctaaaacagtggataaaagacctggatttcccatgttttatcctgagttgctggcaaattctttcctaatctcagtcttcactagataagcaaccaaccctcttggttccttgagagttggggcgtctagaaatcctgcctggactagcaaatatctgtgagttcctaatattgaccagctctgcactggacattaggaatgcaaatataaataaggtactgtttatgttctaagtactcttaaagttcaatgcaggaaacaaacagattatcagagaatagaggtgataagtgtcatggcccaacatggcagggggccaggggaacgcctccctcaggtggagttaaagaagggagaagaaggatggtatggcttttccaggaagaaggagaagccagtgtaaaaactgagcatctggaagtctatgacacatctttgaacctgcaagtattttatgtggctaaagtgttgaacacaacactttcctacatctaaaatgtgcaccacacctgagatgaggctgcccgatcattccaacagtaacatctgataaaagaggccaggagttgaagtgggggcaaggggcttatctttgcagttggcttagaggggccttctttatcagttgaagagggcaggaaaggctgttaggatttttgtggagagatgttgggggtggggggtggggtgctgcacctgtctctcacaggctcctgaagaaaggttgaaaataacagcttttaatactgaataggccctctcattgtggaggcaggctgagataaacagaacttttactatcatgagtgctgtagctcattgcagtctttattgtgaaagtgttcatgtgcataagtcagataaagcaaggatggttttccattaccatcctaatcaaaatttccaaagcttttagagatagctttaattcttactctgtgaagaaggatgaatagagtcattttctgaaatgtttccacaactatttcaggtattgagtgttttatatcttcccttagctgccgaagagtcctggggatccgtaggggtgagcaggaaggggaaatgcacaggcttccttcatgccagttgctgagagagagcttagagacaaatacctgtggtaatgtggaatttctgagttgagcatgggtcaactaaattaaaataaaaatttttattcccaagtctcaagttgaaatgggtaagccaagaaggtctgagaccgcagggagaaaactcctggaggaatccactaaggagacaagtaggcagaggcgcttaaagatacaaacattaaacactcacccagggaatgccttcatcctgttggctctctttgttctgctcaaatatctgtctggcatcctctctccacctaaggttaaaattcgggcattaggacataacgtaaaaattacaactaaaagtcaaccctcctgatatcttctattcaacatttcttccagtgcactattatcttcatcacatattttttatagggtacttactgttcgtggtattggaatgggtcatgggaatagcaaagttctaaggcaagttctattcaaagttctattctcaccaatgtgttttccatttatttttaaaagacagggcattagaaagtacaattaaagattacaaagaatacaaaaatataacggcacatatgataatgagggttagtgatttcatgtgcagtgctctaggagtttatgaaaggaccaattgctataagaaaatttcttaggttcgagactgcagtgagctatcgtcacatcactgcactctagcctgggtgaaagagtgagaccctgactcaaaaaaaagaagagaaatgttttttaaaaccttttttgcttttgtaaaaaaaaatttatttgtatatacttagtgcaagcgcaaatttcttacttgcatatgttgcgtagaggtgaagcttgggcttttagtgtacccatcacccaaatagtaaccattgtacccaataggtaatttttcaaccctcactcccctcccacctcccgacctattggagttttcagtgtctattattctactctgcatgtccatgtgtacacatcgtttagcccccacttataagtgagaacacacagtatttaactttctatttctaggaaattttacttaggataatgaccttcagttccatccatgttgctgcaaaatatattatttcattctttttcataactgtttagtatatataccacattaagaaaattgtcttagaatagctgaagcttaaaagaggcaggagttggataagcaggaaggaaaaggaagggtatttcagggtgggtatactagttatctattgtcacatacaaatcacttcagaacttagaggctcagaacaacatttattatctcagtttccgtgggtcaaaaaatccaagtgtggcttagctgcatcctctggctcaaggtctctcatcaggctgccatcaaagtgttacctagggctgtagtcagctaaaggctcaaccggaataagatacacttcgagttcactcatgtggatgttgacaggctgatatggtttgggtgtgtgttccatccagatctcatgtttaaatgtaattcccagtgttggaggtgggacctagttgaaggcactggttcatgggagaagatcccttatgaatggtttagctccatccccttggtgatgaatgagttctcgctctattagttcatgagcgagctgatcatttaaaatgagcctggtacctcctcctctctctctcttgctccctctctcaccatgtgacatgtgcccaggctctcctgccctgactacagagaaatggacattagatgtggtcaaggcatctctagagcaatggttctcaactctatccacatatttgaatcacctggggatatcctttgaaaatactagtgtctgggatacatctccagagattttgattgatttggtgtgggcttgaagctctggcttaccagatgactcaacctccttcccctcctcttgctcttccctccccctggggttgaaagcaactggcttaagaccttgctattccaagtgtagtctagacaaacacaatcagcatcacctggaaggttttgagaatgcagaatctcgtgcaccatcccagatccactgaatcagaatctgcattttaaacaagactccccaggtaaattatatgcatattaatgtttgagaagcactggtctaggcattcgtcattattgaaaacgttcatggaggtaaaaaaaaaaataaatcactctttcccaaatgtcacccaagaatccatacttgtaaaaaatctcctgaagggatactgatgtgccgccagggctcactgataggcagtcagtcatccccagttcagtttacagattatttgtgttactaccaatataataaatattcttattggggtgatagtgagtccttgtatgcttcttagaggaaggtattacataaattctaggttttatcatttctcattcatccacaagcaaataaggaagtggattaatatttactgagtcaatatactttttaccacaccacgatggattatccatggaaacccagaatcttgtgccacataccttcaattcaagatcaagccaaaaaaaaagatccacaaattattggtgtctgattaagtctgattgggaagaagaggaacaagagacacaagaatgtgtgcgtccagtggtccaatcctgcaggatgaatgaggacatgaagttctggcccgtgatggattggggtaatgtagaaccagaggttggcctggggttagcatgaaaaatagcctagagacaaggaggaggaaatcctgggagaaaatacctggactgcccaacaatctgagggtctgcgcacaatgaaaaaagaaaccagacaaaaattaaagtaaaaaacctggagaaatttaaataattcctgtgcttactagcaggtaattaaggaagcattttatgtaacatctgaagcctcagatttagggggagacagggccactgaaggccctagcatagtaagggcatggaccaagtttctctgcagaaatcccgaagccaaatgagcgatatgaacacccactattatttttgtattattcattttctttttttctttctttcttttttttttttgaaacggagtctcattctgtcacccaggctggagtgcagtggcgtgttctcagcctaccataccctcctccttccaggttcaagcaattcttctgactcagcctcccgaatagctggaattacaggcacccactaccacgcctggctaatttttgtatttttagtagagacggggtttcgccatgttggccagtctggtctcgaactcctgacctcaggcgaatcgcctgcctcagcctcccaaagtgctgggataacaggcgtgagccaccgtgaccagcctgtattgttaattttcttccccctccactggtaaggacaattgagagttgactaaattcttattattgttgcctccactgttctgctttctgtgattcttatccatcatgagaagggctgacttggaagagttcagagcagtgaagagaaatcccagagagtgtctgccaacactcaaaaagactttgaatttgacgtcagaataggaataggcttgccactctcaccagcctcccaagaagagtcattgggcaggctggatggctagaaaaagaagatacctgtctgatgcccaaaggcagctagaaggcatcctggcttcaggaacagtgccatcacctggctgccctcacaaagaggtcatccaacattgtgaaaccatgactatgagtgaaaggcaagagaaaataagggaatctgaaaccatgtgaatatgccacttcctctgcatcacgggacaccagagacgggcaacgaagagaatgttacttctatcatataacacattctcgattcggaaggtgccacagccttgagaaagtcctcattacaccatcttgaaagctctcagggatgatataggtagggtccaaataagaaaatggactcaaggaaatccaaattgtgaccttcactttgaacaattaaaattttaaacagaaaattagaatcgttgaatttgaaatccagaaaggatcttaaaaacaaagtaggaatcccctcattcagtttaaatgttcactaaatattgaatgagtaagtgatcacccagcctcaattcaaatattttcaatgacaattcttgtttcaaaaaatctgtcctataccaaatcaaaatttgcctcccataacttcatatctttatatttgttatgccttccagagcaacgcagactaagttcaccttcgcatattcaaatatttaaagatagctatcctgtataaccattcctcatgactgtctaataaattttaaactccttgagagaagcatccaagttcaatatattttcctgtaccaatgcaattcttaatagagtgactcatctgtagcgggtagtcagcaaatgtgagttgaatacatgaattaatatctatgtgtccacctgaccaacagttctactcgggtgtctcaaaggcacttcagctcaactccaagacttaaatcaagatcttccttgcaaatatggccctagcctaagattccctatctgaaggaataacaccatcatttcaaacccatccactgctctccatccactgccaccagccaggtcaaaactaccattttcttctttggattgtttctatagccttttgagtaagttagccggcctctggtactattcagtatctcctccccacagcagccagagtgatctctccaaaatacaaatatgatcatgtcatgcccctgattaaaaatccttgagtaacttcccattgcagataggcaaatgaccaaaatccctaaaagtcctctaagaccttgcacagtctgactcctcacctcttctgccatacctctcactcttctctccctcattttccaaacatgccttcttccatctattaaatacttgaatgtaccgggtgccttcccaccccagggtctttgcaacacttctcccactcctcatcccctgtttaactcctattgaaaggagttaaacaaaaaagatcaaagcctacacatccgcttttcagaggcatcttgagatctcctaacaatttcaggttgtttattctttaatgctttcatatatcagtttgtaatattttattaatttgattatgcctattttctcatgagtctgtaagctctggagatcaaggactatatctgcatttgcttattcaacctgacaaatcgcataaacatagctgtgtgaataaatgaatgaatttcccacattctgggacttcccagaatttgatcatcatcacagactctgggctgcagtggggcctcaagccttgccatattctcactttttaggggtctcggagactccagtgtcatcctgagctggagtccaaggcttcttagaaaccactgatttctactcattctgtctggcatactcaagagcccattcttgggcacacaggacaactgaacaggattggagggtccttcataggtctgagccagctcccacatagggaccctgaacaggtaagtaaaacctgcccagagagtctagctagacatgaagaaatcagaggggcccaaaatgattattattttctcagtgactactggctgggcttatgatgatccctcttggtgtttttcattttgcatggctattttcagtagctgtatcattaaaatacacaagtctataattatggggatgcatatcctcatccctcaaatatgtactgagcacgcacaatattcctggtcctgtgccacacgctcggttacaaaggcagccaaagctcaattcctgtcctcaaggtgctcttcctagtggaagaaacagacatgaaaatagaaacttactaacagagaaaggagcaaacaaaacacagagaaggaagtgatggcctagagatggggagggtgtctcagaggaggtgacacgggctcataacagaaaaagcacttgtttccccgaggtaaggtgtgcttgcaggttccttaagatgacccaggagggaagatgagcatcctcaacagttacacacaaacacactcaccttcatctctgatgcttgcagtgaaaataaataactgaaaataggcccaacgtgctgtctcatgcctgtaatcccaacactttttttctttgtttgtttgtttgtttgtttgtttgtttgtttttaatcccaacactttgagatgccaatatgggaggattgcttgggcccaggagttcaagaccagcctgggcgacaaagcaagaccccatctctattaaaataaaaagaaaacataaaatattgaaaaacagccaaaaatatgctgaaaaccaccatggcacatgtatacctatgtaacaaacctgcacactctgcacttgtatcctggaacttaaagtaaaataaaaaatttttaaattaaaaaaatgaaactaaataaactgaaattttatggaaaaatacaaaaccccagactagacacaatcagcttctttttgtgggaaaatgaatttatatcaaagctttcataggggttctataaccacagaatgtagttagttccctgccaagtaaaacttagatacttccaaaatgctgctattgtacacaccgcaaaacagagcagccaaaatggtagtggtatgggttgggaagataaagaattaagaaaagtaaagaggaaggggagaggaaaaggagaatattatttccttgaatgatgatcactccttttattaataactttctgttcttattaaagagatgtcccaaacctctgggctttcccagaatttggtaccactggtgcactgacctatcctcatcctgccaatgtgaggaaacccagagagactagtcaaatgccctgcagagcagcaaccacgccagtggggctggctgtgaactttcactttggtgtgttctttgatttcatttggtgtgaaatattgagatttctcctcagatatcccagcgccttgtagctgcactggatctataaatctttatctgggctagattgaaccattttcatttatggagttgtttttaatcagagcaagagtaaaacttttgccctgtacaaaagagtcagctgtaaactgagccattctgcttcagctttcagcttctcctctgaagttgtgtctcttctgagagctctggaataaaacagctgccatagtcatctcacccttccatattttcctctttgtattagtcagctctgctatggtaactaacagtgccaggacctcagtggcttacagcaatgaacatttactttttgttcccacttttactaccaattggctgctgagctctgctccctctgtcttcccattccagagcccaagatgaaagataagccactatttgggacacactttttttttctgacaggatctcactctgttgccgagaggctgaagtgcaatggtgcgatctcagctcactgcagcctcaacctcctgggctcaagcgattctcccacctcagcctcccaagtagctgggactacaggtgtgcatgccaccatacctagctaattttttattttattttattttattttgtagagatggggtttttccatgttgcccaggccagtctcgaactactgggctcaagcagtccacctgccttaaccacccaaagtgctgagattataggcatgagccaccatgcccctccacactgtttttatgacagaagaaaaagaacaagagaaatgctagcagaaactccagatacttcttaaaacttctgctcagacacagcagacattatgtccactcacattcatcagccaaagcccttccatggtcaagcacaagatcaactagtcagggactcacacctttcctgcagaaggcactgcaagacacatagcaatgggtaggaagcaataaccctttttcatggaaagaaggatcaaatacttcagaataataattataacctaccataccctttaactccacccatgtaatttgtctccatcctggggagtttctcctgctgtcaacttaaaaggaatttaaaatgattttttttcttcttggaattcttctggggcaacatttgcccaattattcttcagaatgtcaccatccctcaagatgttaacagtggttgcacaatttaaaagaattccaccatcagataattttggcaaatgctacatattaatagcctcctcttaatatttacaattcttattaccatattaaatgctctgagaacccctgctgtaaagatacctatttaacgtgggattggaatcacagaattctttttgtaatggcacagccattaagactcacgaaattctataggcaaataccgtcccaaaggattacgcaggattcagtcagatagattcctgctgtttcctcatttctgtgcatccagactgaaggatacctaatgacgttgagaggagctatgcataaggccaatgggtctgtacaggcctcaaaaagaaggcttgcattttttgctaagaccaaactcaatgtcagaaacctgaaaatgttattcagatactactctttgtctactgaattaagtataaacacttcagactgtcttttgctccttcctttctttctgcaacaaacgtatcttgagtcctactaggtgccaagtactatgccaggcattgagtacacggtatgagcaaaacagacatgcaccctgccctgtggacttgccagtttaaaataagagagacagacagaagacagggatatgagtaaatagccagtgatcatacaacctcccagtggttagctacaccgttggccacccattcctccttgaaatgctttccacacttagcttctgagatgccactcttggctgattttcctcttcatcactggcttctccttctcagtcccccttgctggctcctcctccactacacagcttctaaatactaaagcagccagggtctatcttctctcctctatctctccctagatgatctcattcaccctcatagcattaatttcacatatgtgcccatgactcccaaatttatatctccagtgcaaaactctcctctgaggatataatcttcccccaattgaaccgccttagcacttcccactcttgagttatttcatgtgttttctcttttgccatgattgttttcatacttccttcatcctcttcctgacttataaacccctcgaggcggggatccttggtctgtttcatcttcagtttccgtagtgcattgcagagtaactgtttaatatatgattattgaatttaatgtttgaactgaatttctgctttagggatcactgagacacagatgtaatgaaagggaatattttatttaaagaaataatgcctcatccttctgtatttccaaatgaacaacctcaaatgagagaacacagctacagacattagcatgaggtgaatacttaagtttaaaaatgctaaatcaagccagtatcatcccttgtggtcacagcagctgctgctgcaaaggttttataaattgcctacattcccgcaccccatctggcgatgctggtgtgttacagccatggatgacttactcttcacaatagccttcacttggatctattccctactttaaaataaaaagacaaaaagaaggtgccaaagggcttgcctaaagtgctcccacccaacaagagtacaattcaaccacataatgctgcctcctcagcatttagaagattagattcagggccaaaggggaggtcagaagaggaaggccccctggattgcagcatttggtatgctgtccagctgagtccccagccatgttgtgagtcaatgcgaacacagcaggtttcaataaaggcaacagttatctaagcaggctgcagccgtgactctcagctcagcctctgggtcaccaatctgggacgtgagctggcacctcgttaaaaaaggtattctgacagagagatggctgtcagtggactcttccaaaaattctctttccctgggttcttctagtccatctccttggcatgtgccattccctatgcatcttttgttagactacatctctggtttctcaccacagcctggacactgctgatgggctagattgctaccatatgctttgtcatgcaccgtgatcccactcacaatgttattccagtgggatagatgctgagatggttcaccatgcaagaggaatcgtgctgcacgtagtattttctttgccctcctttggtaacttcgcaagttcccacagtcactactcagttatgcacgtgtgctaactcaggctcagactactttgcgattagagccctgccaattggatagcttgtatttctattcaataatcttttcattcactcatactaaacattcattccatagctcaatgttaagagccctttaacttgtcatatacatgatgactataacagcactcgcattctaagctaggctttaacacagcgctacagtggtgattatagaacagccactctgaactgcggcttctctagctgtggtgaatgttataaagaaagtgtatttactctagtccttgcccttttaccagtccccacacactaccaaactcaatataaaccccacataaccagcaagaatatctgaggtgtgcaggttatggcaatgggacagcagcagacgcacagtgggtgaggttcctgggacatgaccaggacactggtttatagtggcccaagctgctgtaagtctaagatcccactcaaatactgtactcactttcccacttgatggtttaggaactcttttctagcccccaaagctacattctgagccactttttttttaaacctacacagctgccttcccaaaagtatcctgcagtaattccatgttcctcctccattgtttcctcgttagctctgactccatgttctggcaatctttcagcctcattcctttttcctcccagtctgtaataaaactaagcaaaaggtagtaggtatattagctcaagaattgggatgtacctgtggaactgttgcgtgatgcaagtttttgtcaatgactatgggagcccctggcacggagggccgggcccaccacccctctcccaagggaaagaggacaagtccccatccatctgtcttctcccctcctctggcatcatagacccaccccagtagatagggtcatctcactgtctcccattggaggtggagtgggggagggtctcactcccagaaatgctcctacagctttctcctctcccttggattgaaggatgaaaggtagttatttgcttccccataggggatgaagcagggagtttccctagggttctgggagggcccacccttgtcaccaccctgtggtgccccaggggtaatcggccaactgaaggaatgtaagatctatataataaaatcttaattccacagaagtatgattccagccacaaaatttaagctctctgtagacactaaacactctacatttccataagtcccaccaccaaaggaggagaaaagagcatttatattctctctaacactgcgctatcccctcagcctactcccaaccaagaatcttgagcaaaattctttgctccacttcagaggaggaaagtgggaaatgttttttcctgtgtgcagagactactacaaagagggaggggctcctgttcgggcccatttaaactaattttccatctgctcccaatccaggtttttccagttttacctctttattgggatattgttgaatggaagcacataattaccattattttattttttataaatgggcttctacaaacaaaaacacaggattagtctattattagcatgaaaacctgtgccgtggcttctctgagttctacctggggaccagcacacccccactgtcttccagcgagcagaacaaatcaaagaggatttccagagacagcaataactttacattccacccactgctctccctggggcagcaaatcttcactgtgaaatctgcaattccaggagagcagaaagcaatctatctccctccaaaaacaagttgccatttcagggaactggacacattttcactcctaatggtaggtctccttggattactatggtctgccatgagcctgggaattgtaagacaaaaacagaggaaggaaggaaggaaggaaggaaggaaggaagggagggagggagggagggagggagggagggagggagggagggagggagggagggaaaaagaatgcaaagttgaaatatagcaagaacccattactctatgagtccagtgcgctacaggctgggttccatctcacacacacacacagtgatgtcccaatgtaaggaatcccagctagtgggctccccaactgaattctacctctcagaagggagctggataggacaaaatttctatctgaaaggtcagagcaggattaggaggagaaaccaagaacacagacttagcccatttcaactagcacagaaggacccagaatgccaggtatgatagcacctaacaaatatttactaagcacccactaagtgcccagcactgttgaaagagatcaagggaacagggagatggttggtgctgacgtaagtttgtaagaagtgagcaatcaccaggcagcaaaggtgttgggggtccgcgctggtcatagagaaaggacaaggagcagaagactggccgatcccaatgccacagcaggccctatggtcacaggtgacacctcttccttgtcccctcagtacaacagtgtataagcctttactgtcctacaattcttctttttgttacacagtggctttcaaccctggctgcacatcagaattatctaaggaagttattaaaatcctgttgcccaaaacccaccccagactaatgaaatcagactccgtgggggtggcacctaggcttcagtagttcttaaaactcccccggtggtcccagtgtggggccaagattgaaaaccattgcatggaggtaattgtcctaattacctctccagcttttctctgcctctacattcctcttatctaagctgttatattgcctttttatttttagtttgttctactttgtcctttcagtagataattctataatactccattaaaccttttttcatgctttaactttgttttttctcatttaattttcatcgcccactctacttactccctcttcccattatgtttgttttgttttgtgttttctttaattcagcatcaacatttgcagggcacttgatatggacagagtacggcagcaggcatttaactgctgctaaaaattatatttaacgcagtaatattttgtgttagatcctgtgccgtggctacaggctcttgtcttatggaagattggcactttggcttcttccttggaagtagctgcattgctgtataaatttaagatccaaaataagtatattacaataaaaaataaaagaagcatccacaaatatgagggaaagaagcattaacagcagtctgaagctaaatatcaacatcacccctgccaagctcttggcctcattgtaggtggaagacgctgccatgtgcaacaaaaagagaaagggcccaggctgcatgcacaactaacgaggctgttccctgaggaaagggcatttgctgatttagactcatttcctcaaggtcctcaagcaagcccaagagtacataggccagtcgctgagacactgaaagttgagatgtggaagaaagggccaacagactgtcccagaagcagaatgcttcagtcctccagggaagctttgggggagatctgccctcgtgtcctcctacagctcagctgagagcagccctggagcctcagaaccacaggccctgtagttccctgggtctggcaaacccctgggagaacaaatcactgtcctccccacagagccagcccagcactgagaacaccatacaagccagaggatgcttgccaaatagatgcatgaacgaacgaatgaatgaatgaatgactcctctgatgaagttgtcccagggagagtttgtgggaatactgaaaaggagggtggtccccaagctggtaccccagtccttgatactctgatgtggctttttaatttctctgtcttccttttaccttgatgtatttattctctatcaatctatttgtttatttatttatttactttaggaatcaagccagacaccttgttggagcaacaagagctagagatatttgttccttttagaagaagcaaaattttccagtgccaactgacagggaagaagatgaataattacactatgtcctggtaaagaggacccgagacggcttcctgattttcgtacatcaacaaggagacgtctatgaccctggtctccagcacacctttcttggtagagttgagaattcaaccagccagttcttcctggagattctcagagccacattgagagagcagaggacttacaagtgctgccctatccatggtgactccccttggcctctaggtaagtcacacactgaagcctgcccctcccaccttccaccctggtcagctaatctaggttagtgcaggtctaacctagattacaaggcgtgctcgtgtgcataatttcatgaccaccaacaaccacatggggcaacgttatccccattttattgtccaggaaaccgaggcctggtgtggtaagtgacttgcaagtaagaggaggagtgagatataaacccagattcctgaatctaaattcagtggtctgtactgcagcatagctgccgcctcttgagaactagagtgggcagtgtggaagtgggaattcccaagttcccaggcctcttccagctcagtcttctatgtaaaatttttcttttccaggcttgtctgagcagaggtagagtgaccctgccgcctgttcctcaacagtctgtgcaaattcaaagaaatagagtgtgaattcaaggaactcatttgaagaacaggaaaagcaactctctccttgaggttatcggggaaatgaaggttgaaacatggatcagaagacttgctgaggtcccttccaccctcagctcttccattctgttcccaaatgaggcccaaaacacagctttctccatcactctttaatctgttggttgatttgtctggtgcacccaaccagcactgtggccctgaaaataaaatgttaattacatcaatcttacagccatccatcgctagccatctgatgctgatagaaaggcaggaagcactcgtggcagtttgcatatcagggtcagcagttcctttcttaaccctcctctgtctggcaaggctaagggagcagacgttcctgtaatgacctggcctgtctttagagctgcagccctaagagctggttttcttcctgtggctatggtcttggcactgagctccttcctgctcttcttttgctcttgtgtgtagcggaccacaacatgctttcagatcagacatcctgtgggcagaagaaattatttcacttcaataagaatttttgaagaccagtatgggttcaacgggtgcttttgggagattacaccagagataagaacagactaaatcacacgcgtgaggcagcatttacaaatcatacaacacaatatgcaatagcagcttctgagtttctgcagaggaaaggctaaggacagcaacctggttggaagatgcctcaggaacttgccttgaggctgtattttcatagcacataagattgggaaagacatcaaagaatgggaaaccttccattctggagagatggagattatgggggagaatggataaagcccccaaaaacactcttgcctctcctactaactgttcaagtctcaggtatcattatttgtatgacaaagagaaaattaacatcgttaagcaatgagccaagtgtttacaagtataatttcatttatttctcacagaaatcctatgagttatcttctcccattttacggagtataaaaaaattagttttttctagaaatcacatgaagggacagacatccccttggcaggaccaaggaagctgtggcctaattgctggccttgacacgaaggaatgactgagcacaaagaacacagcctacacagggccggaggagggttgggtctgagggcagagccctggtggatgtttctgccttccacctgggcaccctgagacaggctgtgtttttgttgaagttccatcttgtcctgccacaggcccaggccaagctgactgctcctgacctggtgaagcactagccacactctgccccaagctcccgccgcatcatcacctgtcctctcctgtactgtcttctacctctggctttgatttattgttcataccagctttctctcttagtcaggcctagaggaaggttgtttttggccattagcaataaattcttaaaattccctctaaccggtggaagatataaatcacagtcataaacataatacacattcttgggacttttcaaaatgacttcctgaataatttgagatagttcaacaataattttctagaaagacaggcttatttgagccctgctaactactcttttgatattaatacagctttaaaccctctatacttctttctgcctcaaggcttttttaatacatgtcctcatttgttacatagaatgttatttccccacccatgccccatacctgtttcaggcagggtccaagcaggagacagggcactctcggagtgattagagagagtttaatgaaagggacttttacaaagctgtggacaggtgttatggattgaaatgtgtcccccaagggacacattaactctcagtaccttagaatgtgatcttatttggaaatagggtcactgcagatgtagttaccttaaatgagttcatactggagtatggtgggcccctaatgcaatatgactggcattctatatgacagccaagtgaagacaaagacacgcagggagagaaaaccatgagacagtgcaggcggagactggagtgatacaggtgcgagccaagccaaagaccatcagagtttccagcaaaccaccaaaatctaggaagaggtgaggaaggattcccctacaggtttcagagggtgcatggccctgctgacaccttgatttcaaactttcagcttccagaactgtgaaacaatacgtttatattgttttaactacccagtttgtggtactttgttaaggcagctacaggaaattaatacagaagggttatgggaaaccaaaaagaaggtggtgaaacacccagggctggcaacaaagaaccgctgccatgccaggcctgaagcgtgtaggggaggagcctttactgaaacctgcagctgtggaagaggagttatagcttccagtgaaggaaggcactctcctccttccctccagtctcctgaaggtgtctccattggccaaaccaaatgggatggagagccggtggatgctgccaattaaggtcaggctcagagtaagaagtagagtggatgtgcagaggcaaacagactcagtctcaactgcaatgccacttcctcttcagggaagccttccctgacctcctgaccaaacctggcctctgtaacatgctcccatagtccttctgcttctgcagaatatttatagctgcaatggagggataaattatgcaaattattaagtgatgactggctctcatgctagaacataagctccatgaaagaaaacactgtgtctgccattcatcaatggcagaccctgaatcctcagggcctggcatatagtaagaatgactaggttttataggatgtgccaagaactaagcagcctgatagaaaaaggtcaagtatttaagtccaaacagattgaccttggcaactttcaaagagctatagacagcagacagcattatgttctgctgggggacagggttgctgatgatataatgtgtaacatcaaagaatgtgaccaccttgaatacttgctaatagtcctccaagagcagtaggcaggatgggcagttgtgcaaagtgaggcgaggcagaggtgggtggggagagcaactactatggggtcaagaaacttcatctgctcctatctgaatttttttcagggcagtctgttcccagtcacactggggaacttaagaaagcttagatgagtctttcctccactaacctgggaatgtaagtcctgcatccaccctccaatatggaagccacctttgctcttgcctttttgcttaccaggtgactctcttcccagcttctgctgcactctctagttctcattattaatttacctgtttgatttcaaaatttcaaagattgacctttaaactcaaaagtggaggtcccaaaaatcctaacctcccctcttttgaagtccatgtaaatttagcccgtcataagttgagatgtagtggtggtttctaagttttttacaatgtttggctttgtgtaatttaacacaggtaacctaagaacccttcagaaaagaagctagatgagctcaataaagatcaggaaactctggctcacatttggaagaccatgtttcattggattgctctttaacacatgggtaaatcacccttatccaactttgcctagagggagtttgcagtgaacacaacaatcattacaacatcttcagtctttgtgcacatgctgttgatctcctcatttggtggttcttttgattacagctgtaaatgccaataattcttcttggtatgaactatgaacatcaccacatagtgtctaacatgtacatctaacctgaaactggaacaacaatatcaaatttaacgtctagggaaggaagcagaaaccctgtcaccaattaaataagctgccttaatctcctctcagttggcctaacttacctgaaccgtactattggtcttgaaggtggcactgtcatcccattagcaggcagcaggccctgcgagcctcctgtgatcagctagatttctctggggaatgaaacagctgctgatagggactgacttcctcagtcacaagtgtttcacaagtgtgttggttcagaggagggaccaggcagaaggtggttgagaggcagagctgcccctgagtgagccatgcagaggatctcctccctcatccatctctctctcttctgggcaggtaaggcagaccccagaacttgggccaagcaagactcagcagcaaagaaacatcaaggctcacaggaccttgtactcatggactgtgctccttactcaatgacctcagcccccagccctcactgagcccctctcttgtgtcttttctctcaggagtcatgtcagccattgagttggtgcctgaacaccaaacagtgcctgtgtcaataggggtccctgccaccctcaggtgctccatgaaaggagaagcgatcggtaactactatatcaactggtacaggaagacccaaggtaacacaatgactttcatataccgagaaaaggacatctatggccctggtttcaaagacaatttccaaggtgacattgatattgcaaagaacctggctgtacttaagatacttgcaccatcagagagagatgaagggtcttactactgtgcctgtgacacccaccctgctgcagctctacttctgagcagctcaaaaaccactgaccaggcgcggtggctcacacctgtaatcccagcactttgggaggccgaggtgggtggatcacgaggtcaggagatcgagaccatcctggctaatacggtgaaaccccgtccctactaaaaatacaaaaaaaaaaaattagctggtcgtggtggcgggcacctgcagtccgagctactcaggaggctgaggcaggagaatagcgtgaacatgggaggcggagcttgcagtgagccgaggtcatgccactgcactccagcctgggagacagagcaagagtccatctcaaaaaaaaaaaaaaaagaacattgccatccatgtagagcagcaattccaacaagatcgtgattttctcttgaataaataatttaggaaatagggaccagagaaagctagtgtttctacctttctttcaggctcagccactcagcttgcccgtgccctcccatggtgctcagataggcagcccccagtgggacagaagagaggagagatggagccaaaggaatgaactgtagcatctactgtgacagttttcttggaggctcataaaaggtatgaccacagagccacagtgcttagagtatagcatagattaaggaggcaccttacaatttacaactatgggtgacatccagtttttccccagccacatgcctctgaatttacatgttctagaggaaaaggactggcagtggggggaggctcctctccctccttcagatcaaatatgtacactacctgtcattttgcccaacatggaaggaaaggctacatctctagcatctctagcatgctctgttgttttgatgattactgactggatattttgttttgctttgttttgttttcttcatgagacggggtcttgctgtgtcccccaggctagagtgcagtggcgtgatcatagctcactgcagcctcacactcctgggcccaagctggatatggtgttttgctctccctttcttctctatctctttacttccacatgtgctagaaacaaaacgttgaaaaattgcttccactggcacttccttatccttctttggacagctcaatttaacactgcacttttatcttgaacaatgtgtttttccagatttagatgattgacggggctctctactccaaggctgaacctgtggcagaaatcagccttccttctgtcctcatctagaaaatctaccacttaccttgttaaataacctcataagaacttgtggtgatagacatggtcagtgacttgattgcggtgatagtttcacagatgtacaggcatatcaaactcatcagattagacactctaaatgtgtacagtttatttcacatcaagtatacctcaatacacttgtaaaaatatttgtttaaacccaaaatggattttttaggcttctttggactacttcaggcaacgtctacacaaaatgttcttcaacaaacccctctagtcaaatatcctctagtcaaatatcttccacagaagtacaaagaggctgacagggcttgccacaccttatttggtttcagtcagggcttttcactgttttgccaagtgtcttcccaatcctctctcctctcatgattctgcctgacctttcatatatataatacatgttatatatatatgttataatgtgtcgttgttccatgcattttagtcatgactgcccccatgagctcttatcatttatctccccaaatagctatattctaaaccttcagaaaatctctcttctctactcttcatcccaaactcactcactttgacctgatgcatgatcccaacataggcctggaacctgccttctacctttctgccccaccccattgggcaacttctttggttgaacggtctgcaaggccctggatactggctctgcccttggacaaaatcgggttcccaaatccccatccagatacagcactctgagctccacgatcttggaaggggtttggacccagccttccccagatgtatttaaacagagggcctgtcatgattcatcaagcccactgcctgccactcagatctaattctccttctttgaacaaatgataggcaagaaggtggagtgcatctccaacatggagaggatacaattattctcctagtttgaaatcatgatttggaaaaagaatgacatctggaaaactggttatgcagatgtcaaagttgtggagccatggttttataacgcctgcaagatggattcctagtaagaccccaagtgactccctctaacagagactgggaagagtgtctctaaggagaaggaggggaaaaaatatctggacaaatccataagactgtatgtcttccgtattaataactaatatctgttgagtgcttactatgtgccaggcagcattctaagcacttaacgtgtgttatatgattaatcttcacaacaaccttagtatttactttctattcttgtcctcattttacaaatgagaaccccaaggcacagaaaacctaaaatacttgcccaaagtagcatagctagtaagggagggtgacagatttcagactcttgatgctgcaccagaggacacagcatgtaatttggggagatgggggacccatagagaaagccaccttcaggatgtgtcagaaccaagggacaacaggggctgtgccctcaccaccaaacctgttccaattgatactcccgtgaccatctgtcaaaaaactgggacaacagaacaatggtcccaaatgacctctcaagtgttttctaactgagattttgtgatcctgacacaagcttcacactgtcttctaaaatcatctgcatctcttcatctgtgaaatggggataataagagttctaccttcactgtgttataaaatatataattatagaaagtaaataaattgcatagcttatagtagctatttaataaatgttacctattataagaaaaagcaaactgcaaggaagaataattgagaagaaagtgaactaaattactgagcaccaacgaaatgcagccactttacaggtatggactcacttatcctatgacaactcagtgaggtcattatcatcctttctgttttgcaagtgaggatactgagactcagacaggctggacagcttgcttacagaagcagagccaggatccggatctgacttgaagcctgattgtcctggctgggatactgggctgggagctgcggaatgtcctaaagaaataccttacctatagcaacatctcatgtaaaggatggctgggaacaggtatgtgaagtctggtcatctttgctcatgcaaagattgctcttgactccttggccagtttccagaagaagggatagtaggaggtcttcaactccttccccctgcctcctctcccctgctttaaaacaccaattgtaatttcagcttccaggttgttctcccgagatggctcactcccctgactgaaggaagacagctactccccagcccactgccactcacactcctgagcaccacccctaggtcagcagcttttctcccagggtacaccatgagaaacatgagagactggcccacatattccctccttctgatgcttgtcaaaggtagtctcttgttggactcccttagatcctcggggtgctcatggattcactgccttttcctctccttttcaggggcttgcctggagcgaaaaccataggggtccaaggccggcataatgagagctagaaaaattccctgggtttctgtcaggtccatagagttggtgactttaccacccacatatatctttgctgtcaagcaaagtgtgcaagtttgtctcttccgttgtcatcgacttatcacttatacagaggcagcaatggggcttgagatctgacaaccacaattctctgcattcaaaagtgagcacacgggtaccagaaaacactgcggtggatgaaggtgcaggagccaccgtgtaaagaatagaaattaatttctaactaaatgtctctgctttagttagggtcttagtccactgcagtatcttaaacaatacatattcaatgataaattttccataatgacaaggtgaacaaactcagaatcaaagctcctttcctactcttcaattcaacacattaccctaaaatattaattgaaatgataggattatacagcttttttttttgtcagagcactttattcattctttcagtaaataccatctctcatatctgcttaatttttctccacagcatttatcactatttggcatgctacatattttacttgtttatattttgttgtctggctctccactggaatacaaggtccttgatggcagagatgagtttttgtctgttttgttcactgctttaactccagcacttagaataactttggcccataacagacactcaataaatgtattaaatgaatgagggaatgaaatacatatgagtgagtgctacgtaccctgcactgagctggatgccagggacacagtggtgcacaaggctggtgcggactctgccttctgagatgttctccccaagcctcatctacccactaaaaaaatgctactgaccgtaacaagattttctgaagagttgattatagagtactctggaacaccaaataacttactcttggagagcagacatcgaggctcctaagtgcattggatgttagcaggggcaaaatgaagaaaatagtagctttctcttttctccaccttttctctcttttgagtcccaagggtcccagccctgagtctgaggctgtcaaagaaaaagcgaaacacttctgttttatttcacaaaggaatttcgcaacgcttctctccaaacagactggctggggcatgctatttcacaatgaaaagccacgataacacagtttcctaaacaaaggggcgattcctaactccctctcactttatcaccactgccaccaaatgattttggtattcttcaagaatacagaatccactgggtctttttgggctttttagcaatttacacatccacaaacacataggtttatgagcggtaacagcgtacattccagtgcatgaaacactgcagggattctctgaaggcgtgccctggatgctgcaaggctccaaggcaacagtcagccagtggaacagtgtgccacccagcatgctcgacttgatagaaaaaagacccagtgacagggcaaaggaagtcaagccaacatgcaattgcttgtattaatttaaataaagccaggttctcaaactccatgtttaaataagaaatctaacagtcataagttttctttttacctgcatgcatatgggagaatagggaaagtttaaattatctttctggcttaaggacaaaattgcatgagtatttataactttcagaaaagaaatgtcagtctaaatatattactagggcaacaaattattaagaaaaaaaacccaaagtacagtcttttggaaattaaagttgctttcatagaatatagcagcattcactcagtaacaattcattaagtacctcatatgtgccagacgcttttctagacacaatggaagcacagctctcagaatctcaggagcttatatttcagtggaaataaacacaaaataaaataagtaaaatatatgtcagatggagataattgccatggagaggagtaaaacaggcggggagagagagagtgttgtcagcaggcttgcagaaattacaattttaaatcaggttgtcaagaagggatacaataagaaggtgacatttcagcaaaggcctgcgtgtaggcagggagcccagtatttggagtgtggatgtttgctggactccctctgttagaaataacattttcatgcacattcttaagacataatcataccagcttttctgtaggttagggagataaggagtcattttttctttcttatcttgctaagagctctttcacaagtagttcacactttcatttttcaaaatcaagcgatgaaatgccattaattagcacaaagtgtgttggggagtggacgcgagggtttggcaaggaagcagtcctgaaaagatcaaaacttacaacatgaacaggaagatgacagcactgattattgacaaacggaaaatggggcatggcattttgagccctttgccttgagtctctccctagtcacgtgaccacattctgtggactggtgagtgtttcttccccaaccacagggataagaatacaaagtgagtgatgcatttctctcactggtccccagatgactccactctagcagccccggaaaagaacctgcagcctcatctatacctgcaggttgatgtgcctcccaaaaactgtctcactcagttgtggagctgaaatcaatcatgtgttcacctcagtggggttcttggtttttcttttctggcttctccaaaaagccaatcatagagaaacctgaggactgtggagccactatggagaaggctggagtgcctttaccatccctagctcagctttagggattcaccctccaggacctctgagtgtgctgggatcacacggcctaaggtaggccctagagtcagtttctgtctttacctgccacctgacaggagtgagaagttttacttagaggcagtgagaagggaagtcagcagccccagggacagtacaaaggagacacagcctgagtgtgtgttgtcagaagctctgtcacagcgaaggcctcctcgggcataaagacctcactgtgtttgcataacacctgtgttataatcgtgagtgatcaataaaggattaactgcctcagtcatctaaggaaatgaagaagggttttatgcaccaagttcataaataaggacacagaaaaaaaccacgaaggccagtgtagctgcctctgtacgttgaaattagagaactggtacaataacaataacccacctctgtagtaagaatcaatgtaaaatctttgagttcatagctagtccatttctcagcatcaaaaccatcattttgctttctgtatggaggacgtccacccccacatatgcacactcagagtgtcagagcaatgagaaaccaattaccatcaggctccacctctttggttgaagacatagaaactgatgaatgaagaaattaagtgacttttccaacatcacacatatagtgcagacaggtaaagtgatatactgtacttctgtctctttcctccaatatcctagaagtcaagggctaagaaaagacagaaagggtaaaccatgtgatcatgccaaagtgaaagaaaaatggcagcggagtgttctccacattccagacaactacctcctgccaccttctaggtggcaatgcagtccaggtaggtaaagcgatatacaaaaataaatagccttaatcattcacaaaaatattaatgtgtgtcaaatttaaaaacaatgaattgcaaattgcccctaactttggcaagatcctttcacctaccttaaaatggacaagtttacaaatttgggctataaactgcatataagtttttgttggttttttttcttccttgagacggagtatcactcttgttgcccaggctggagtgcaatggcacaatctcagctcactgcaacctctgcctcccaggttcaagtgattctcctgcctcagcctcccgagtagctgggattacaggcaggcacaaccacgctcagctattttttgtatttttagtagagacgaggtttcaccacgttggccaggctggtctcgaactcctgacctcaggtgatccacctgccttggccttccaaagtgctacgattacagatgtgagccaccatgcccggacacatatgagtttttataagtaagttcttttagtagtgaaaaaagcataggctctggaatcagagaaaaatagaatcacaacccctcacttcatagttctgtgaccttgaaaaatgttgctttaacttttctaaccctctattccctcatccacaaaataaggataataattgcatagagttatcataatgatcaaattaaataattgcaagtaagtacctgagtgactacaaagcagaggtgctcaataatactaactccattcctttcagcacccgatggtctgcagtagagcggtttcaccctctactccagacagaaggagacagaaaagacagaaaagctagaatgggagagaacatggccaatgaccaccagcatttttccaaaccaagaaatctaaagtgcctatcagcacattttttataaaaatacctcctcaggaatgttcttcccacacaacctctctaaatcctttccctgcactaatgatagtgaaggtcccaaaggcaagaccatcactgggagggtctagctccccaacaagagatgatgccctcattgcccttcatttgcagagatgaaggtgacacaggtcaatgtcagcttcaccaatagtaacagggagagtaattttttttttttgagaccgggtctcgctctattgcccaggtcggagtgcagaggcatgaccatggctcattgcagcctcaacctcccgggctgaagtgatcctctcgcctcagcctcctaagtagctgggactacaggtgtgcagcaccatgcctgggtcattttttaattttttgtagagacaaggtcttcctatattactcaggctggtcttaaattcttgagctcaagtgatgcccctgcctcggccccccagagtgccaggattacaggcatgagacctcacgccctgcatgaatgaattttttacatcaaaccttctccaacaaacttggttcagatgtctgagacaagagttgcacaaaggagtctcagtcttcagaaagttcatccttacccagctttatggatgctctaggacacatttaattcttgcatccatttaggaacagagatcttctcccatccttaaaagggaaactataatattaattactgacctgtgatgagtcagctgtccatcctcatttggcccatgctgtctacatgaagttagttttcactgtagtgcttggccaagaaaaaccaagtttttctaaatgaattccaaggataaatagcctaattcctgttctttggcttcttccactaaagaattatagggacctgatctagggaaactggggggaaaagccagggaatgagagccactgtcttgccagaaatgcatgttctgatgaggaaagatagttcaggatatctgcgccaaatcacacattggaaagaagctttctgagatctgaggaaacttccacctgctaaaaagagctagcagtctgctggaaagaaaaaaattcattcaggtgtcagaactcttactcttcactttgtgtgtgactgtagacaagtcagttaacctctttgcacctcagattctcatctgtacagtaaagagttcacattagattgtctctaagtttccttcagcactaacaagccgtgggacataggagaacaaatttgaaagattcctgagatacaggagtatggattcctgcagctgattcctttatgtgacccagtaaggataaaatcgaaaaaaggaactaaacgaaatacactcttgattaatcaaaggggattgaaagtcgtggctaacctcacacctaccttgcatcacctccagctcacctcccttgagacactcctcctcttctttaatgcctcatcatgattctcaaaaactgtgatcactcaaggttgaagcttttaatctcccatgtataaaaggatatgcaaatagagttcagtttcctgttgagtctctgccaaggtcttagcctggcagttctgggaaaagagccaaagacctcatatttcttggctgttaacattctcccatctgtgctcaagtcagcagcctaggcttcaggctgtggtttgtctttagtcttacactttcccaagttttctgaaggaaccctttagaatgttcctgcaagaaagtaagatacaagtggctcccaagaaaccagacagaggattatctggttatatttggaggcagtaagaaaaagaccaggaagtctatattcctatagtatatagccacagaatccaatcttgcaagctacttgaaatgctgatattaattaagtcttaggcagggctttcaataagtcatctgtgtctccaatatgggatgtcccacatcatgcatatgcacagtgaaaaaaagcgaggtccttgggtacagtacagcattcaaaaattaaagatctgaaaaacacaagacatctcagtgtgcttccgggctggaggctctgctaaacaacagaagcagagaccggactaattgtcccccatgtctctttgactgaactcacacaaaatagaatctaccatttttactcagtgcggggtacccagactcaagtttactgcaatgttgttaccaatattctaatggaaaattatatattcagagctatgttaaatttgaccatttattaaacatgaaatttctactttttctgtaagtgccttgtcttacttgtatttcccggtatttcccttctaaagctaactccccaaagggctttcctgtatgttctcacttccattacaaagtcaatgtacaagttaatttttttaatttctttagaaacctttataaagagatttcctccttcatttctctgttatcccaggcagctgtcaggagcaaagagctcaagcctgcactgccttggaacaggacatcagcaaaagacactctcaatctactcagaaggctgaggtgggaggattgcttgagccaggggttcaagaccagcctggacaactaagtgaggctcagtctcaaaaaaaaaaaaaaaagatctcaatattattgttccatacccagtcattcacttggtgttttctgcagcatttatttataaatatctcagtctgttcttaatccttgagcctatattttttaaaatcatactttgatatctactcagagtattgattctcttcaaatttcccacctcttagttctcctcccactctctcccaccctgagccttacacctccaacaatgatcattctaagaccatttatatctcaataggaaagtgatgtaaaacgggtctccttactctgttttggagggtttttttgttgttgctgttgcttgcttctctgtcccaccccaaactcatgtgtgtctgaaatttagcaccaccttgcgacgtttgtgagcatttttctcagagcagcattttgagactgagcctgaactccactgatgttatgacccttaaaagtgtctggctccaaaagactaaggagttcctgcgtaaatccaggtccagctacttcatcactgtgacttgttattggaaaaggttgagctatcaacatattgctcctgtaaaggctcagaactgaatcttagattcttcaggatatttgagtcctctgaggctcctgggtaaagactccaatgtagcagttctgtggactataaatgggagatatccagatcatacaccttcaatggaagaaaaagcactgtcaccttagacgactccaactctgtagtctacttttgtcttcctaatatcatacctcattctccagtgggtttatggcaagcctcatctactcagaagtaaccaagtacaagccaacacactcttgtgttagtgtggaggcccaaagtggcataagtgaatgtgactccagatgaaaaccttcccctctccaacacaaagatgccaaagactatgtataaagcaagtcttaaatcactctatatttccatttgaatatatttccccagttcctgtgcattgcttctgcatacacagaattcaatgataaaaattgagactgtctcctagatacagtaattaactcagctatcaatgccaattgactgtgtagaggggagacaattttgtaccaagatttactaacctctattttaatggaaaaacaatggaaaagctttcttcctactatgactctctctggataaattgcttgccaggaagcgttaggataattctgccatgactctttgtcttccacacccaaagacatttggtctccatcacatatggaggaaggatctccttgttcagcagtatttacaccatcaccctgacacccgcagtcagatctaactatacagcttggctaataaacctggagaagctcatattctaagaaaaaagtggagagtggtgggacagatggggcctgagtgctgggaaactgcccgtgcccactgctgacttggtcttctcaccagctgcttgatctaacagatgcatcttccttatgaggcaccagagaaccagaatgtccacatcctgtggtcccctgtacccttaacaccccacatttgagttcctttccaattcagaaaacaaaacctgcaggctttgagccaatttacaacagatgtgggtcacaacaaccaactacccaggaagcctccaccagaacgcagcgtgagaatcagcttcttagatattcccatacgtgtgatcccatcaatcatttaacaactgtcaaagagaaagactaggagactttctcccgagcatctccagggatttaattcactatgttggaaattaagagattactactaagccataagaaggctaagacagagttaaaagaattattggaaggttggcattacaactttacgtgtacactaggaaaatctgcagctctacctgtagctttgacataatgccttcctataccctgtccttgcccaactgtgactcccacatcatggtcataccctggataggcccctctctgcatgtagagcaatgtgaatggggattctgcttatcaggatatcatcactagtctgtgccaggccttgcaagaatgtccttgtactgcaactatttgtaccagatggtaccctggccacccctaagtgtgcagactttttaactttttcccccaagaaagtggtccctgatgtgcactgcctactgagtaaggctaagaaagataggaaggaagaggacaaagtgcaaggagagaaacatttttgcaaggagaaaaataatgatgtggatgcagaatatttatcatgtgaattcatattaacctgacttcctcagaaaatgtcaccgttagtattagaatgtgtatttccttcggagctctgaaagaaaatatgagaattcaaggggtgctagtgcagaatacacacacacacacacacacacacacacacacacacactgtgcttcactgtggctggaatgatgcagagtcttggcaatagttcgggaagctgctagctgtccgcccattgtaaacagtgaagtaggtcatctgtggctccccatcctcatctgtctgggccattttcttgggccctcctccacatcccattcctcatatgttctcattctatttccatcaaacctcaatctcaagaaatgacctgaaatcaattcgtactaatgtttgagtcatgaaaacagaggaaggctttagcttctctgagattggcagggagggtcgctagtgagcattgtattttcataaagataatagccataagctaaacactgcagcaaccacagcagaattttccaagcctgaggaacactgcccaaaatgaaagacagaggtttgttctctctttgtttggaggttcagtgtggatcatacacagagagtctggagcctcccacagtggacacttcttttcctctgtccagggagaagtccagctggagcagacaaccagagagaacattagcctgaccatggggaaaggcattgcagcagaattaggcccaatagaggaaaaaagatgcctggaaagaaatttcatttcaatagcaggaatagctttgtaagagctgatagccattcaacagtgaaacaagcatccttgtcagtggatgagttcggtggatgactacactgggaaggttgtctacattggttgggagctaaactcagtgagctctttccctcctagaattcattatatactgtatgtatatgattatatatactctgtgtatgtaatcgtgtattacatatactccatatatgtatattacatatacatatattacatatactctgtatatgtaatcatactccatatacacatttgtatccattacatattcaattttccatgctattggatatttttcctattcaataattttaataagctatgttaatattgtatctagagctacattatagtttactcaatcagttctcttcatggttgagcatttaggcaacttctaaatttttcctactatgaaaattattatgatgaacacacctgtacttacaactttttcattatttaaagtcatcatatatgtatatgatgatttggatccacttccacatcccattccttatatgccctcattctatttccatcacaactcaatctcaagaatatttcagtatgtgacctgaaatcaatgcattctaaagtttaagtaatgaaaacggaggaagactttagcttttctgaggttggcagggagggtcacaggtgagcattgtattttaatagcaataatagccataagctaaacactgcagcaaccacagcagatatacaaatggtatatatacaaatatacaattatatttgtataaatatatataaacatataataaagtaagctcctattttcttaattagaagattcaaagttaagaattttgtccaacttgaatatatgaaactttagggttatagagaaattagccaattctactttagatgttttaatgtattaatacagttaaacacacatattttaaaattacatattatataaaataatatatcaattttgaatactgctatttccttttaataattcataaaataactttaaattcttcacaggcatttcaaatcaatgtatttgttgccactagagccacttttttatcctcaaatatttttccagagtatatgaaactcactttgctaaattgaaaattaagaggcacattagatttagaaacataattttaaattgtttcaatgatggcacattattaatacctactttgagacacaatacatactcacataatattagaatcattgttttgccatttatcctgtaagtgaatattcatgatctccacaacaaaacatttactttgatagatttgtttaaacaatatcaaacacttgcagtcttgaaggcactggaagacccaaaaaatagttactacgtttctgttaaactacttagtcatctttttaactaattctatcagctgactgccataagcatccatgagctagcattgattgagatcattccaatgtgtcctcactaaactgtacttaactgttcaaagccaaataattaagtgaaagtatggtaatactgtttttcataattattgtaaggaatcaaatataagggatttcttcttctctgaggatcatgaaccttactccatgttcaaatagatatagtattttttcacagtaaattccccaaagtggaaatagtcactcaaacgaatacttttactcttttgacattaaccaaatggcttccaataaaaatcaaacaatttatatttttaccaacatcttgcccacattgggagtgtcaacattttgagcaaaagctttaattaaatatccatgcaaaaaatggtttgttaatactttacagttttattactagagggttaaaatcctttttcaagtctgataatcaatgattaactttcttcatttgtccttcacccatttgttttttaggttgatggtgttttacttattgatttgtgtaattataataattttgtgtctgagttttacagcatttaaccacaaaaacagcattggtgaaaggagtttcaggggtattgtggatggcagcgggtggtgatggcaaagtgccaaggaaagggaaaaaggaagaagagggtttttatactgatgtgtttcattgtgccttcctaccacacaggttggagtgcattaagcctttgtccaaaaacacccagccgtgacccgctatgtatgtctcagcattgggaagagtcctctgagtgtcatgggaaaataatatatgagttttattgcccctgtgtcccaattattttctgtttactccatgttggtctacagcaatagcttcagaacataaacaaatatcaccaaaaacatcagtgatgaacaattccaaccacacatttcaatgtttactaaatatacccgtggcactgtaaaaaagaatataatggaagagtaaaggaattgggactgatcgtgactgagaacctgtatagtaggctacacactagctatatgatgaaccaagaagttgaacccaaatctaactaacttacataatcccttcctttaaagaacttaatgtccagtgcaaagcaagtgttcaaaaaagtgtttgttgtgaattgaattcatttcattggaatacagcatgcttgcaaagtcccaactttttaaaataatgtgtttctaaagaccactggtctttagaaagaccaatgaccaaagaccttagaccattggtctaaggaccatctggaagcagatccccaaggtgaaattctgacgttgaattcccaaatctaacaggtcatgtgccttgttctgatgagaaaactgtcgaataagggagtagcagtggcatgaaggttgttagtaggtagcataggccaaatggcccagtgatgtgatgaaaagtgcactcctccaaataagaccctagttactagaaagtcacaagtaggtaaacagatgccgggagggacagtttttgttggataaagtcagcagagaaaggcttttggaggagatgaatcctgagctggtgtctacagatagtgacagacttagtgcgactaggaatattatggagaataaaagaatctccctctctaactaatgccaccaagcagtcccttcaccccagagcaaaggcataacctatcttcacccaagtgaactatgtattcttgaaatatatctccttggaactaaaccatttttctgttcacttcaaatcaaccagtgttaatatcatagatctgacagcttagaaggcctgtgttctccttcactcttctcttgaccctatgtgagtttgattcaagagcatggggattagtcccttctcttgaattacaatcaccaatcagcacaccacatccagttgctctttttaagtctaggagagcaaaaacaatgcacaggtgaaggaaactatgcctaggcctcatccctaggttgtacaaagtaactgaatttatggcttcaaggacagaataaatcaaataaaatcaaagaagcccattttcagggaatagaaacaattcacagaaataacaccttgaatgaaattctcatttttagtgcagaaatggaacataacattcttagattacttgctttctaaaagtgaatattctttaggtattactttttcaacattgatgagtttacaacatttctttttgcatagcagacaaaactgtgtaggcattcacagttacagaaagaaaaaatatgactagcttcctgcttcacacaaagaaatcatgcaaaaaaaaaatttcaagccaaaagaaaaaaaaagttttaaaacattttaaagtctcatattacttgctggctgtaatgggaatgtgtaactttgtgaagatgtctgtagccatcttattctaatgatcacttatctttatcaagccattatgtccatcttgacatgatgcaatacacagggcataacattacctacacagtatttctgacataaataaataaactaaaactaatcaaacttttagttctaacaggagacaggaagctagaaaagcaaattaaaggattctacaaagaaacatctagacaaatccagcaggtgagacattccactggacaacaggttcagtcccaccaataatcaatgtcatgaaaaggcaggaaaaaagtgcagtagaggggaagcagtggaaggagaactattaaagattaaagagattttaaagatttaacaacaatgaaatgcacagtctttgaatggatccttgttttaaaaaaaaaaaaaatctgtaacagaggccaggcatggtggctcactcctgtaatcccagcactttgggaggcagagactggaggaccacttgagcccaggagtttaagaccctgtgtctgaaaaaaaaaaaaaaagaaagaaagaaagaaaaaggaaaaaataatctataaaagacatttggagcatttggaggaaaactaggaaaacttgactatgggttggctattaagttattttcgggaatttctgttaactttgttaggtggaaaatggtattgtggttgagtagaaaaatatccttttttgtaatatatactgaagtgaattgtcattttatctgtattttttttaaatactcgagcaaaacaaatagaaaatgtgacaaatgttaacaactgttaaatctaagtgatcattctatagatacttattttattaatctcttctttttggattgtttcaaaaattttataataaaatccttttttaaagtcttcattttgtgggtgggcatggtggttcactcctgtaatcccagcactttggggagccagggcaggtgattgcttgagcccaagagttctaaaccagcctgggcaacatagcaaaactctgtctctacaaaagaatacgaaaatgtcaccaggcgaagtggtgcatgcctgcagtcccagctactagagaggctgaggtgggaggatcacttgaacctgggagatcaaggctcccagtgagccatgagcatgcctctgcactccagcctggataatggagtgagaacctgtctcaaaaaaataaataataaagttttcatttttaaatggccaacaagtctacagcaaatttaaacaatgaaaatatgagatacaatatcttccttaaaaattagcatattttcttaaggaatactgctctgctcgaagaattccctagttctgtaagcgttcgaacaaattaaaatcttgtgtttatataacatatttctaagacaacaatgaattctgtcactaactatatgagtaaaatgaacaagaaaaccactaataatgatggtgcacattttagattccttttattctttttcaagacacagacataactgagatatcttaaaatcactgactttcaagatttgagataatgataataactcaagatcaagtcttccccttgtgttagaagtgggggtgggacagttccagacttccacagttgtaccaatgaaccccaatcagatgattttcaagttacttctccttcaggtgggtgggcatcagagagaagctaagagaaggttttgacaaaatccaaagtgtgtccagacccctcaaataaggtaacctgaccaagtttaatacattcttagggcctaatatggatctcagttaaaaatcctggtctcttttaattcttgtccagttgctaagtgtattatttgacccattaactctgcaagtcatgttggtccattcttcttctttacggttttgcaaaatacatcaggttacagtttcaagtatctgtcacttaaacaagtaagcatttattatttttaatgggagggctaacatattgccacagaaatatagtatgggtactgaagaaaatatacacagactctcaggtcatcactgagccttcccaccatcatcatagatccagcatctgacttccagagtaccaccaagaagaaatcagaggcagatgacatacatatccatggtccttgactctagagagtccagccaaaatgtgtgggtccatttaatcatttctacagaaatgggaggctattgctccaaatgacttctaaccactcactcatccatcactcaaagcatatgatacaattgatttaccagtcattagtaggcaggtagagagtggtgaagcagtggagagagcttggtatttacagctgctattgcaactttggtagcacaaacaacatggaattaggacagggattttcaaagtattgcccacggacttctgagcacctcaagatcttttcagggagtccatgaggtcagaatttttttcataataacagcaaaacattacttgcctttttcgttgtgttgatatttacactgatggtggaaaaacaatgatggataaaactgctggtgccttagcatgaatcaaggcgggggcatcaaatctgtattaataatcatgatattcttcactgccacatattttcaggggaaaaaagttagtttcacttaaaaatgatactgactgtattaccttgctagggctgccataacaaaataccacagactaggcaacttaaacaacagaaatttattttctcatagttctacaggatagaagtccaagatcaaagggctggcagagttggtttcttctaaggacccctcctccatctccaggcagacagcaggcttgccgctgtgccctccagaaaggatggtctttcctctttgtgtggggaacactggtgtctcttctcacagtgtgtccaaatttcctcctcttataaggacatcagtcagattgaattagggccaactttaatgacctcattttaacttaataacttctcaaaaggccctttctgcaaatatagtcacattctgaggttatgggatttagggtttcaacatgaatttggtggaaaacaattcaacccataatactgacaaagcaataacaattattaattttattaaatctcaactttcgagtacatgtctttttagtattctatgtgacaaaatgataagtacacataaagcacttctgttacattccaaattatgattgttatctaagaggaaacacttgtgtggttgtttgagttgcaagctgaactagctactttttccatgaaacacacatttttgcttgaaagaacaattgacaggcaactatggttattcagacttgtagatttgccaggcattttcttaaaaacaaatgaacagagcctgtcatattaaaataaacaacttatagttgttgctaattataaaatcttttttttttttttgacagagtctcactctgtcacccaggggggagtgcagtggtgcaatctcagatcactgcaacctccacctcccgggttcaagtgattctactgcttcagcctctcaagtagctgggattacaggtgctcgccaccacgcccagctaatttttgtacttttagtagagacagggtttcaccatgttggtcaggctggtctcgaactcctgaccttgtgatctgcccaccttggcctcccaaagtactgagattacaggcatgaggcactgcgcctggcctccaccagtactctttagcctctgtcctttgagatgaaaggcgtatatccagggagtcattgccacttcaccctgacctctagaatgaagacacataaaacagacctaaatccaactcacatcttgaagccaagtccaggtggcctgcagaccagtgagcaaaagtgatacatgtttgttgctgtaagcaattgaaattttggggttgttatagatcacaattacaacaaaaatagctgattaatacagatggtgggtcttgagaggattctaccttcatatgcttttaactctatgtctctagcaattatgaaatggcatacctaaaatttttggtggtttcctattatcctcaggacaaaacagtatagcttacttgctcccttaaatgcagttgcattgaactacttacttcctgaatgctctgtgttctttcatatttctttgcttgagatgccctttccttcttctatcccccaattggtccgtagtccctctgtattttcagggtcttagctcagttgtttgcttccctgcgaattcctaaatgactaccccagtgatctgggttaagtgctcacccttttcggaattttcatagcatccagtacttatctctattttcgcactcaaaaccctttttctttcttcttcattaggttgagacccttgagagaagtgatctgtcttgttcatccctgtataccatgtaccagcacagagcctaacccagtgagtgctcagaaagtgccttctgaacccattttaaggatgaggtatctcaggttcagggaagataagctagtaagtgacagagccatggccagatcttcccaactcccaggttctggctcagtgcctggtactaggctgccttatggaatactgccttaacatttgtttagtggtattaaaacacattggtttttaatattagcctgagttaaacatggttggtaagtttaatttgttgtgatttactccataccatatactatattctaaagctgtatagaaatgagtttcacattgtctacatatttggagtattcaagtcatgttctcttccactaagatcaattgcatctctggagaggaatcctcgaatgccacagctgggagatgtttcaaagatcatgtattcactctcctaggttttcagatgagagagtctagaaagatccagagaggtttcacaacttggccaagtcacccaatttcaaaagaacttacaagaaattgggtatctctatcccagtgcagtgatctttttggtacactaggcgaatgtcttctttggtctttcattctggcatttatggtttgagactgtttcagcctgtcagtggatacccttccctggagtggccctaggatagtctgggcaacctggtcctttctttctctgtgtagattttaatcgttatgtgagatgctcttctgcaggaatggggaagagcaggcacaaggtggatgaatcctgaagttcaactattcctggaaggagactgtgtcatgttcttttttccaggcaaactcattttcagaggaaagggacagtgttggaggctgagttgactgtggtacagttcagtcctggctgggttgaggtctcatgcttgggagcaaatatatgggatattaagccaagaaatgaaacagggattaaacaggggcatcctccaggcttagaatatttgggattgtgaactttgagctagtgttatttatctctaccccctgcttctggtattaacacacacggtttgagagttgtagacagactacggcgtgttttaaaaaggataccaggttgtttaacagacttcaaaccatgtcctgggaggaatagctaaaacatatgggagactgtagaccaaaggaagggaggtatcatagtgatcacagtcttcagatatctgtcagagaagagctggcatatcagaagacagttggattctcatgtctgcttatgcactctacctattgcagtatgttggtttggttgaaatatatgagaaaaatctggcctcacatagatatgtagtatgaaaacaaaggagtattttaatagcttgttcaaaatattgtggacatgatattctttatattgcaccataattatttgacaagaggtagtttctttgaaggttagttgcaatgtgaaatctgataccatcttagtgaacttatcatattctgttacattaaaacattggtttatcctgaaatttggatagaacgttcacccatgcatgcttcttaacccatccattagtcacttgagaaaattggttcgctgttaagcagcttccacctgttagcacacattttattattcaataccaaaatattacagtagctaacatcatcactggtctctttaagtcaggaaaaatttttaaatattggtgagctatctacttcacagtgacaaacataaatttcctaaaactctaatttttcctggaagcttagattttctaattagcaggctgggcacggtggcacatacctgtaatcccagcactttgggaggccaaggtgggcagatcacttgaggtcgggcgttcgagaccagcctgaccaacatggtgaaaccccgtctctactaaaaatacaaaaattatctgggtgtggtgggagtggctataatcccagctacttgtgaggctgaagcagtagaatcacttgaacccaggaggtagaggtcgcagtgatctgagatcgcaccactgcactccagtctgagcgacagagtgagactctgtcaaaaaaaaaaaaaaaagattttataattagcaacaacttagcttaggaggctgaggcaggagaatcatttgaacctgggagacaaaggttgcagtgagatgagatcgcaccactgcattccagcctgggcaacagggaaagactccgtctcaaaaaaaaaaaaaaaaaaaaaagagagagtgctggtggaaacccattatgtgacgtgtcttgaagcctcagcttagaactggcacaccgtcacttccactcatattctatgaatcaaaacataatgaagccccaatgtcaatagagcctgtagtaggaagccctgcaaagtcccatggcaaagaacctggaggtacacttctattacagggaggaagtgaagagttgggaagctgcattctcatcaggattcccaacttctgtttcctctaactaatcctattcacaccagtttctgatggctgcttcttgggaaagtcaccagcactagaaggagctcaatgagtctcatatgggtgagtcagaagcttatttcatcaatcagctacctcttgccatttcaaagactagtacctaaggccagctacactcaagagtccaagtgacagttctttattctcacctggttctccccatgaggccttttgctgtatgccatcccattacatcgtctgttattgaagccataacatttcttatttttctcttttcctatttgcttttttttaatcagcaaaagaatgttagactttatatagagagataacgttccttggagtttatggggcaggcatgcagctgtatgtagggtggaaagtcattacaaaggtcataggtaaaatagtcataattaaatcaaaccatggatttggataagactccagggaaagtgtgaagagtaacctttttaaattcctgctccctgttgataaatagcaacaacaacaaaattcctactcttctttcatggttaaagtttaataaggtcactttcgatgagcctatcacctatcatattgctttgttttgacagcactagaacagagatcaaaggcaaacaagaccagtgtcttgtgagccctgaggagaggttttgagaaggcaatgactgggtcaaaactctgaggtcaaacaagattaaaactgaaaatcatccgttgaatttggccagagctgctgcctctgattgctcaggttgtgccttcacaagggcatctggcagagaggagaagtggggctaaaattcaatgcgtgctctgccgccagccaaggccctgatgtggcgttgcatcttccggaaagggaaggccttttataaaccacacaaaagtgcaatctgttcgccaagcttgaacccaaggggctatctctacattcacccagcagggctgccttttctaaatcgcacaaagcaccatatgggctactggcctgaatttagcaactgggaggaggtcaatggaggggacacaattttaaatttacatgaaaaccctttgtaaactgtataacactattcaagtgtaaagcaggaagaggtgattcagaagcttagcaggtgacaggagaaattacactgaccacaagccttttctgcctaacccacagcatgtagaatctccatgagacgtttaagtacccgacaaactcctcagtgggaaaccatttgagggcagactggccagaaagcacagatgggaatggatgtgattatttctaaaagtccattctagtcacaaaccccaaggcagatctagccagtggggcagaagagccccagacagaagcacctgagccagcttggcctgacctaactgtcaggaccctttgatcttgctggagcttgacttggagaaaacatctggttctggggattctcaggggccatatagtgtgaaaccgaggggaagtttttgtaaagctctgtagcactgtgactgggggatacgcacagtgctacaaaacctacagagacctgtacaaaaactgcaggggcaaaagtgccatttccctgggatatcctcaccctgggtcccatgcctcaggagacaaacacagcaagcagcttccctccctgctttggggcctggaagggatagcaggaagttgactggaccagggagatgaccacagctgctgacctctcactcactgctgttcttccttgggtgaaactggcatttctacattttcttacagcacatttggggaatacaaaaaggcctttcttaaaaactattcttgtcttgttttcatgttgattctattgcaaaagagagttatatgagccacctcatacggaatttctaaattcaaacctctagagagatttacccaagtgctttgctttgcagtttgggaggatggatttgaagagagattgatttttttgtaggcaatcaccggccacagttgctcattctaaagctgactgctctgtaaatcacccagtgcttcatgccaccctttctcctcttgctgtgccacacgttatctgcctttaaagcagcagcactggtgtctgtaaaggccttaaccctggagtagtcatggagccaagacccacccctttgacagtgccagctttccaacacagagagctgagtatgggtctaggaagtgagagcaatgtaaaacaatagaaagcaacagttcagagcactgcatcaagtgtactgtgctggaaaggtccgccataggaaatatggtcctccatactcctcagacaacagccttccgaaagcaaacctgtccctacctgcagatgattaaccatctatgaaccggctgggtaagcaacaagtgccatctttcatggagctgagccttaaagatcctccagtcctaaagctgacgggaagaaggtaggtgggagcagcgctgaggtttttggaacgtcctcaagtgctgtgacaccgataaactcatctttggaaaaggaacccgtgtgactgtggaaccaagtaagtaactcatttatttatctgaagtttaaggttaaggcatcctccatctaaggaggcagaaataatcctgaaatgggaaatgggtgaaatagctagcatttaggaggactcctgggaagaggtgaaatatggttaatcctttccataggagaggagcagaaggtgtctgtaaaaaaagagtttggggcatatgaagggacccttctggctcagaggaaacagagaactctgcccagtccatcgaatttgggtcaggctgtagaaaccacagagtcattggcccaactccctgagcagagtcagaatggacacagaatgaagctgacttgagtccaggtggttttaccaacgtgattccaaacgttctgacctcccttatgccaaacacatcctcctggaagagctcagaactgaatccgtctcctgggcatggagggtggggcgagcgcaagtagtccctggtgttgcgatatttctctttagaagaaaataacctgtttcagacatttgtttctaattgtttgagctgcaaatgaaaactaggttactagtgagaaatatgggacattctggttcccactgagaccagattccaagcaggacaaagtgaatgtgtagtgcttccaactaagaaatgctttgaagtctccaggacacagccaggagagttccctaccactcaccagtgttcatcgtttttgcaaagagtatatggtgccagtcacttattaacagttatgcaagaatcaatgctaaggttgttgaaggattgtgctcaacacagaaggcatctttggtgtcctttcaatgacatttgaattcgaccgtgtcttgctaaaaaataaaataaaataagacagtggtctccacctggcagcagattccagttagatagtacatattaatcttaagtaagaaaatgtaataaaccaatacaaaaacccatttcgaaggtcctagggaagtctagcaataggggtcagtggtcccaaatctgcccaaccagctgttggaaaagaaacagcatgccctgccctggctgggactttggcactcagctcaggtttttcaaggtaaaagaaggctctagagagatagggtggtgatggtgggctcttctcagagaccaaatggggacaaagcagttccaggcatatgcaggcaaggaggctgaggaaggggaaggacaggcatgagcaacccaagacctcacacactgcagggagaaaaggggcaggggccctgccgtcagggagaaagacacccaaagttgtgctagtggagtcagtgcagagatgttcagacttttttaaaaaatcaacatcttagtaagattttgaaattttaactaatttgggcctttgcctttagaccttattatccttaaaattttcactaaaataagtttatccacaattccaacaaagctaaagactgattatcctaatttccctttgtttgccaagtaagggatgaattaagttcctctgtttacccatttacttggtccatatttccctaactgcggagtgcacagcacatattttcagatggagagacgttctttttatttgcatggatctatcttttaatggctatcagaatagtacaactaggctatcaaacccatgtgatttcaagtttccttttaattatattttaagttaaaaagtgaataaatttttttaaattattaagcaaattatgacagatgactatgaccaaaaaagcgggggagatgtgcttaattgaagtttgggaagtgctgaacttcatattggtgcatttcatcagcctttgaagtgaaaaagtaaggggtatccagagggggcacaacctagaatatctttgaatggcagcttctatttttaagctaccaacattggattaaagagactgcactgcaaacccagggcctttatcttctcagaagccttttgatgctttttttttccttgggagcttctttcaagttcttacttacggagctcctgggtagcacaaaactaacagaacaggtctatacaaacccacagctgtagatcccacactttagtcctctggatacagtaaacctggagagaccacttagcttcgtaaaacagaacagagaaacaggacaaaacagcatggaataaagtaatggaaacgtgtacttctatggtaacaacagcggcagtggggaaaagaggcatggtcgttgggaacatctgcgtggaagtgggccatgtgatggactttgaatgcaatctattattgtatgtcacaattatgtaactaccactttttgagtgcctaccatttattaggccactgggctaagtcctttaatgattatcacttcactcagtcctcactacgatcatgtggaattgaggtaccatgacttgcgttttatggatcaggaaactgaatcttaaaggggttcctcaagatcacacagcttagtaaagtcatcatttgaatcacctgcttgatgccagcatctgtgctcttaagaagtctgctcttccatcagggctgcagctagactagggcatgtgtggaggtttttcctgcctggcccagcctctgcctcaggtctctaatgagctccttttcaagctgaatcagaaacaacagttatgccacttcccttccagtgccatccccatcacttctctcaccaaggaagaacttctgaacccccgccaaaaccagttacccaaagcagcattccccttccccaggaggagccaggtgaggcccatctctcacattacacccctggagacccagggtccctaaatacagaaaggtccagacgatgatcagagcatcactctttccctcaagaaaaggagtccacataattctggcctcatcaaaatgtttctcagattccaaaagatgaccttcccattcctccaggcccactagcccttggcctggcatctggcactccctctcactcccagtcagcatctcccagaacagagcctttgcacctgcaagtccttccacctggagccattttctcccagggactcacacagttttctccctcccctcctccaggtctccactcaaatgtcatttccagtgaatcctttccctaccacctcatgtcactctgaagacccctttccctgctttatttatagccctcatgtctacttgaatctttatatgctcgtttactgtctgtttcccttgctctgtgagagaaaggactttgagttgtttcttactgcacctataagtacactgaaagcactaaacaaacatttgttgaatgagtgaatgaataaataaaggaatgaatgaatcagagaaaaagtcagctatggtataaagcaaaagaaaagaaaaatgaagggaagctggtaacctacagagccgagcctgagtcctggctctgcaacccatcacaggtctctgccacgaagtgccaggcactgttctgggtgccagggaatcgacatgaacaaagcaggcatgaacttctgccatattggagcttattttctaatggcaaaagacagatggtaaactaaataaataaataaaaaatatatacagtgcgttagggtggtaataagccctgagaagaaaaataaagccgggaaggagaataaagaggactagtgggagggaccagcatgcagttttaaacagaagagtcacagaaggtctcactggaaaggtgacagtggagcagagacccgaggaggtggtaaagtgaggcatgcagacctctggagagagagcacttccaggcagaggggacacagggctgcctggggtgtgtggctggaggaggggagggagtgatggggagagaatgtgaaaatgaggtcagattggtgatgggttggggagagggtggcttgtaggccactgtaaggactactgcttttggattcgaaagggaagattggggagtagaatggaagtcacacgtaacctagagaaaagatctagagagacagaaacctgaataccagtcctaacccacggccctaagaagtgggcaccctcttcatatcacataacaccaaaaaatagcttctgttctttttcagcaacctgtcccaacaatccttcctgcttgggagctctgttcttagtgcaattacattccccacgcttctagtaaaatgtatcttctctgagtttagccctaataaacattctaataattacatcgagtctctctagttcacagatgctgtatctaatcttataacctataatacggaagatgttatcctcacttcgtagagaaaccagataaagctcagtgagtttaaggaacttggccaagattacacacttggaaagggacagagtcaaaactaggttttggatcttctgacatccttctactttacaacgactaggaaccacccttcatgttagtgattctccaactatcatctacagtcttttaaggattgtaaactgatccgaaaaatccatattccctccttggtttttatgagtgacatacaggcaatctcatagattctgatgttcacgtataacagaaattaatttaactgtcacttctaagtgtgagagtgtcattgaagcttgctaaaatttgatatgcatgaatgtgttattaaaatggatggaaaaacttaattctattttgtactaagcagtttggctgctgcacaatacttggcaatgatgcaaaactctcagatatgaaataaatttcccctaaaaggttggaatgcatggtatatataacctgctaggtccctgcctcacctaagtgtagcccgaaggtggagaaccactgctctatgaccaacgttccacccttctttcctcttgatcaaaccaaaaaacatctttccagtctatattcattctctcttatttgagcacaaattctgtcagattgtaatatgggcaaaagcttggatttctatttgatgctagagtcacctcttgttccatcctgaaggacaacctctaagacggaggagaagaggctaggccagatgggacagaaaatcacatgggatgaatatcatgtgacttggcaactggggctagggttgccgtaaagggaaaagcaaggtagtttttggattaggtatgtcagctgtgccagacccctgatctttggcaaaggaacctatctggaggtacaacaacgtaagtaacctacttttccttcttatgaccactatgtttggcaattacatttgttaaatatttttctaagtcaccaggttaggaagcagtgctccagtaggtaatatagcaagggatggcttgaggaacaggaactgagtttccgataaaatccaggatggcgtctgtgcttcagtgagccgtcttgatccattgtccttcctagagagtttctattccctctacctggctccagaaagctaccctcctcaacatctatgcatccaccatgtacagatctaggccaccactgtgatcagactcacatgacagcacttcggggggtggacacaaggtgaaatgaggagcacgctgaaccagtaaatcagaggccaagttccaatctgtccaatgcattaactgacaatgcattagctgacaaactctgtgacttaactgcactgaactatagtttccctatagttagatgaaggatttccaagctgtcttccagcccttgcccactatgatcctgattatccccagaccaattcttatgaacaattgggaggaaaagcaaggaagcccaatggtgtgactgtcctattacccagtaggaattctgtgatttaatggaaaaaaaaaaaaaggcactggaaagggagtgaaaactctccctatgcatcccttaattagcccttgtgtgatcacagaggtttggaaaaatgatgccttgaggctcctttcagtcctaccatctattactctggttcaggggctggaaactggaaattgagtgaagcccaactcagccactcacttaaccacctttacagtgcctttgtctgtgagatggatctaaaaatatcacctcatagagtttatttcaataactttgttgaagtagtataaacaccagctgtttaagtaggaaagtatttatacaaatcatagtcatctgtgattattatagtcctttggatagaccccaagtcttttgcatcaatggctcttgctccaaccattgtgtccttccacctctcgctgaggcacagtcctgttgtgattgatttagttgaggcttgttgttacgtttctgcctacaacggccatttggcaattctcagcaaaatatgtgaaaatgttatcctgaagcaagatctgggagtaagagatggcaggttgaggagataatagcagaaaatctaaggacttgcctaagtgtcaaaactcagaagatagcagacatcaaaaaagctgccaaaatataatgctcagatctcagaaacccttgcaaagctctgtctccagctacacccattctgctccacccacccacttccaaacagatgaattagactgacagggagcaaataggtagcaaggtttttcgtaatgatgcctgtggtagtgctttgacagcacaactcttctttggaaagggaacacaactcatcgtggaaccaggtaagttatgcattttactacagctcagtgtgtatatttctttagggttgttgtagcgtagtcctgaatgaatggggcttcttgggaagtaaagagttccaaattagaaacccattgtttgttgcaaacagtaggggtaaaatttgggagcaaatgcattagatttctcttaagaaaatattctgtatatgcttggaaactccattctgaggcttggtattcataagttttttacaactactgaaaaaaagccctaggtcaggcttttagttttgggctccctagaaccaggaaaaaggcaagctgtggttgaggagggtctctccagtatttatgagggataaaagtcatggtcacagtgtaggaagagggaaggttagaaagaaaaaagtattacgaaagaaggagttttaaaaagaggatctttctctcctctctctctctctctctctctctctctctctggataagaagccaatcttgcccttgtcacttttttctgaacttgcattaaaccaacataaatggttcagattaaatggttctcaaggtcccatcctggcctgggtctgctgagagcagttatgagctcacctctcctgttagccctgaaactgggaactttgcacaatggttcaggagcctgtatccaatgtagaaacacagccaccaactccaggacaatagagaagtcgtggtcccctactggagacattgtctactggtagcctactccaatgtttggaaatccaggggctatattctggtagtttgggtagctgccaacagtcaatcactaagaccagtccagagaatagccttcagacaccttccaaaatgccaagtccattgggagagccattacctcttacatgattaggtattgattttgtttattcagaggaaataaataagtagggaatggtacatgaatgtggctaggctatctgaccaaaagtccaaaaagtgactggtgctgtcaacatggtctctgcctctcagagaataatataaacttatagggattctccactgcctgttgcctccagggaaatggtagaatttggtgagttttcttatctttgaggggagagagactagagcactgaaaaggagggaaacagaatcatgtcgtagctgattgtagtctgattgatgtttagcaaattgcatctgagcaaaaactactgtgtttcattttcccctaaaatcatttccacttgaaatttggaattatctgcagtgttagaatcaaatctttgaggctgtgcctttgggagtcttagggaagaaggaaattgatgaaactgatgcttagcccctctgccaggatgctgaccatgctccccgatgacactccattcgcttctctggttttcttctcctgcagtggtgaaatgtaatatgatgatgtgaagctcaggtaggggatgtgaaaattttcaaatcaaaccccaagtccttaaagctttgacagtgaataatggccctacacaactgtcattctcttttgcctggctctagcccaacgatcttgatttttggtgatgaggcagagtaattcacatggtctttatgttacattgcacatgatgactatatactcctgaaacttatatctggatccagagtcaggagaaattataaaacaaaaataagcaatgcaaagcaagcactggcttctctgacctgtgtccatgacacacagcaccagtgggctccctgagcagtgaccaatttcttgttcaaccctcaggtccttagaaagcctttcgccaagctcagggaattagaaagcaggttcgttattattgtgagactcagtctgagtgatgggggaaattaggtttctaatcaaaattctgtacttgtgacccaagagaatggaaccagagtataataagaatggaaactctttctataaccctcctctcctcaacctaacatttgttgtaagaaaggtcaagttaagtgccccatccctaccctcaagctattgtgttcttcttggatgcccctctcaataaactggaagttagattttccatcatgaaggcagctatttgtcacctgccaccctcttctcttgctctgtctcagccctgccctagtatctcttggatggggatatcaccctcacatctctatcaagcagttcaactattattagcttcaaagggaactgagactctgtgtactcagccccttggtctcatcaagagcagctttgtagttctctgagctgtggggtctctaggctgagaactgaggctggggaggcagggcacagatgttacagctcaggccccagggccagctccaggctagttacctgtgaggcactgtcataatgtgctcctgggacacccgacagatgtttttcggaactggcatcaaactcttcgtggagccccgtgagttgatctttttcctatatttctgggataatttgagtcctggcactggggctgcaatccagtttgcattataaattataactagtaaatgaaattataacaaggagacagagtattacagatgtgaaataggccagagtgaacacactagactgagtcacttaagtagctctgtaactctatttattttaatatatatactctatattaaaacaatagctcccatttatttctgaaatcttcagagcagcccaaaaaacacaaagaaatctagaagaactacactaagagttggagcattcaggtgcaagggagacagtgggagggatacttcagccccaattcctcaggaagctgcttcatctctgcacatccctttggctaagctaactagtatgcgtgcctccttgcaaactgaaaacaagtgtcctacagcttggaagattctggagaaaggtagttagcatggtcagagtaattaggtagaacaaacttttatttcagggtttaagttaaatcccatattggcagaaagtcttgaaattctgagtgacatttattacagttgttgcaattcttaggggatcagtaggactagctatgagaatctaaaacataggtgacttctaagtttataaattaagaaagactgttcaggaatggtacacacttttttggtattgtttaccagcacataaacttagcaatgtattggtgttcataaaaagagaaagtctgacaataaagcaattttccaaagaaataacacttgaaacacatgttgcaatgtaattatatttgtggactaagaaaaaaagactacaagttcttcaaagataaacgattaaatctttaatctaaattctggactacaatttcatacagcttcacgtctgggtttaagtcaaatacaaaatagactaggatgcatatggcaactatattgagtgcactccagtttttaaaaaggtttaattcagtcagacacccatttctttggttaccaagatgccaaacaatggattctataagacactttctttcaaacaatcgttttgaaaatataaacattaatgtagaaagagggattcagaaaaatgttttatcaaatcaatgtattatgctctatctgaaatgctgactaacagagtcagagcacaatatcataagtgcatgaccttcttcagacatctgtcttttcagttatattgtattattcaaattactcaaacccaatctccccagcccaaagtgatgatttgacaactgcctgatgaatttagcttttaaaattctagcaagccttaattatccaactaaatcagaccaggattaagagatactcttaaataaacaaggagatagggtgtttattttatggacaagtttcttttgtaacttgtaactcccttgaaagtcagccagagtatgtctcaaaccaaagtcaagatagtgagcaagaagtgttgcacttatgaagggaggtgagtgagcaatgcatgtggtttccaaccgttaatgctagagttatcactttctgttatcaagtggcttcagctatgcaaggaaaccaaacaggggaagttttctcaagcaggttgaaagcaggttccaagaaagccctttgaaaaatgtctaatcctttcaattgtctagaactaaagccaaaaacataaggaaccagattcttaggaataagtttcctgccctgagtgactgaaacagaatcagtcttttagttgagcttctcagcagaggaaacggggagaatgatgatggtagtgatggggggtttctctgaatagttgattttctaggaaaaccatgatcaactttggtccatttacaaagccgtgatcagcagaaacttcctgactagcaatcgccccctctcaaccagatataaccagttgatctggcagtagctctgctgctgtgaacctcacagctgaagcccaaattcagattcaggataaagcattagaaaaattatttatttttatacagaaaattagccaggtgtggtggtgtgcacctgtggtcccagctactcggaagactgaggctggaggagagtctgagccaggaggcagaggttgcaatgagttgatattgggccacttcactccaacctgggtggaaaagaccctgtctcaaaaaaaaaaaaaaaaaaggaaaaggaaaattacttattttccatttacacattcattaccaactttctgttcagcaacacctaatgtcttgattatagaccatagtaggtaaaagtacactggaattcaatgtatttttcatttgatatcaagaagcaaaattcacctaagtttcaaatactaagggccaaatttacaggagcaattaatattaaaagtcagcattaaatttaggattgaaaaatgtatcttgatcatcattcacaggttggttgtgtttcttggtttcaggtattaacagggctctttctttaacagttatttgaagatagcctaagaatttaagtccccatggacacaacatttatcacaattcaaaaacttcagtgaggcactgtgtgaaagaatcatcactacctctctcaaagcttcaagacttgtggtcttaaggaaagaaaagtatgcatgtacagggtggtagtccaaagtgaggcacaaaagaagagaaggccaggagggaagccaatcctgggaccaacattccacagttcctcttagattaaaacaagaatgaacgggcttcaattggttttatttctttaaggacttcctgaaaatgatcattgttatcctctgattaaagactcaaaggaaactatacagtagtcagtcccctacagaagaatgagtattcacctaaaggcagaaacatgtaccacctaccttcagcagatccctttccaccctttccagcagatctggaagggatggcacccttccgggaccccaacactgccatcctcagaacctctgagccagttatgcagtccttctcagaccctcgattctttaagtgacagaatgcatagcatgagcacctgccctgatctaccatccaagggcccatgcatttacaaaaaaccaactggtgcagagagatattcagcctgacctagattgtccagaggattgattaataaaacacagataatcggctggatgcagtggttcacacctgtaattccagcactttgggaggccaaggtgggcggatcacctgaggtcgggagttcgagaccagcctgaccaacatggagaaaccccatctctactaaaaataaaaaaaattagctgggcatggtgatgcatgcctgtaatcccagctactcgggaggctgaggcaggagaatcacttgaacccgggaggcggaggttgcagtgagccgagattgcaccattgcactccagcctgggcaacaagagtgaaactctatctcaaaaaaaaagaaaaagaaaaaaaagaaagaaaaagaaaaaagccacagataatcgaaacccagatgatccagaaacttctttgtagttgtcattttccatctgtgcttccagccctatctcctagcagctcctaactggaagtcaaacttactgcctttcatttctgctccccttgcctgtcctttcacagaggtggtaataagcccaggtcactaacaggatgcatggaggtctggattgtagtgtttggctccagggtaatcgaggtaatcaccactgtttaacccccacaaagttgtgaataatcatctcacctaataagttgattatatttgcaggaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacaggtaggccatttctagcttcaaggagctggagattatggggaacaagaattgggtgaaagggaagttagagatgtaactgtggacaaatcattctcagtatagcatcatgctggaaataagacttaggcccaactatagcctgccattggcaggggagggaaatgcttgtcatccctaagatggaatctaaaataaagcccatcttatttcttcctcatctctcctctttacctaccactgtccccttcatactagactctgggattgaaagtcctcgtgcattctaatccagtgctaaattccaacaaagggcaatgcggcctattgtggggctaagaatcctagttcttcccgcatattggtgtgcctggatgttgacctcatggtacaatgaaaaaggctagaatgggaagcatgttgtataattagctatgtgaccttcaccaagtcacatcctctggtcctcagttcactcacccaaagtctcctccagttttaaaagcctacaatcctgtgagcctcttcattcccaatgtaaccctgaccactgctgtttgttccagatcacgtaaaaccaaaggaaactgaaaacacaaagcaaccttcaaagagctgccataaacccaaaggttagttcaaatcaaagggccaacttcagaatcaagggttaaagcaaactctgtaattgtccactggggccaaaatgtatcagatttcaaaagaaaacacaaaccatgctgagcccagttggttctgcagagcctctgactctcccagcaaggcttacctggctgtcggcatcggtttcccaagcttgcctggctgggtgtcagcagcagcctaaggtctctgacggctatctggcaccatgctggacttgcaggccagaaagaactaggcagacttggggcaggctaatatcagtgttgcaggcccaatttctggaagggaatttaatctctccctgaagccaccctcttcactctttttcagccatagttcataccgagaaggtgaacatgatgtccctcacagtgcttgggctacgaatgctgtttgcaaagactgttgccgtcaattttctcttgactgccaagttatttttcttgtaaggtaagaattagccgcttcttattcctatctctacccacaccatgctgcacatggggaaaggggatttagaaatggctaagaaaccaagaagcattggaaagggaaaatagagacatacttagaattaataaggtaggctatctcagctactcagcaaaacagcaccccatttcctgttatcctttcattttgagtcagactgaaacccattaggtagtataatgtactatttttctaatataccagagaataaccctcactttcactccagggagaaaactgaagataaataaggagaattcatcttctttactgctattttgttcatcgaccaagagaccatgggttatttgcaaggccataagtaaagctttgcctgaagactatccagaggaagcagaacctatctttgtcctgataaagggaatgccagctcacactccttaatcataggaccagcctgtctatgtgtggatcagcctgtctttgggatgaacctacacacagcattagtagtgaacagctcactattagctactcaggatgcatacacagttaggtttgagatgtcaattatttgcctgttacttgcattccgttctcaggtaatctcatacacgaaattgaaaccagggcctgggtttgcgtgtgaggcttctccccctcactccttctccaatactcacaaatgctcatcaaccccagcttctgttctaggaacaaccctagactcagagtacttgactgatctgacccagacagtaaacatacccagtcatctcaaaaagggggtccagctcacctgttattttactaacagtcccagggacacaggcagtgtggctgggtaaaaagagagctatactaagagtcagaagatctgggttttatcctgattttgacactaacttacatgttaccttagccaggtttcttcatctctctgggcctgggtttttgcatctgcaaaacaaatgagttaaaaaaaataataaccaaaggagaacaaaagagtctcatgacttgtgccaacactgatagctgaactagctgagctattgccatgtgtacatggaaagtgagccacaatagattagtgatgtctgcaatggtacagtatagcaagtaccggccaaccccagactacatgacccctacgattccttctagcactggcagtctattctataacaactttcttcactgcaggctgactggcatgaggaagctacactcctgaagaaaccaaaggcttacaaaaatgcatctccttggcttctgacttctttgtgattcaagttgacctgtcatagccttgttaaaatggctgctagccaaaccactttttcttcaaagacaacaaacccagctcatcctccagcttgatgggaagacaaaagtcctggggaaggggggtttatgtcctaactgctttgtatgctgttttataaagggatagaaggatataaaaagatataggactctttttttactcctacaagtgatacactttgaaaatgatgttttgttccttttgactttctttaccttttgaagtagaaagtgggaaccaacaggttcacagcttcattcctcatgaggcaaataggccttgggagaagaagagcgggtgcccttttatctaaacatggaaggctctgctcaactgagcactagatttgctacaaaccagcatcatcttcttcctcctgtcctcacggcttgtcccaccctctatgttcacttcaggagccacactagagattctgcatggcgtggaggaggacaaagtttcagcactttctgcctctcctaatactttacaaatgagattacatttgaatttgctaatactttatgagcaggcaatgaggtttccaaaatctcatctaaatactctccaatctattagcaaaaatcagagtaaaatacagaggaaaggcactgctttctgttaattgatttaacatgcatgaattagctccctctgagttccaggcactatgctgagagtacaaagaagacacaagtctgctttcaagcaactcactgtgaaagtgtttttgaagggaggaacagaaatgagacccctatctttccctataaaaacaacatttttactgtcttttgcctgccaatctgtatttgaaaccattggacactgattctctggcctgggactttggcattgatggttttctgcctttcttctcagcctctgcctctattgcatttattaaactgcattgtgtgcacctcgcctctggctttactctttgcagatcaccacagggggaaactcagctctgtgagctcactattagtcagccaaaagccaaattgaacttatgggtcacactgcactttcctgagccccaagcctacagaggccctgccttggagacccagcctcgggtttcctgctgcctctgctgatgccgctgttacagcaagagcaacagcagcacctgcagcgtggccagtgacctctgctactgccacccaggaaggccacagccttttccaggagcactgctcaggtgcagagccctagcaacccattattgtggttctctcagcacctatgtggagcatcaagtcgggggttatgaggttacaagtgaaagagtgactgtcgccaacaactccacttgccatccccgacagcaaactcccccatcatgtctactacaccttgtatgtgtaaggaatgctgatttccaaaacattcacgagttaccttgtgtaatattagggtgtttcctctgaagttgttaggaacaaaaagatcatattctcatttttcagataaaacaaaaatgccctctcctcaaaaaagtatgtatcatgtccagagtcattcagtgaggcagggatattgctgggagcagaaccaaggtctcaagattttcagcccaaagttcctgctataagaacatactgcatccccaaatgaggacaagatgtcaaagtgagtatcagctagaatgaacttcaggattgtcccatatttagcatataaatgagccaccctctagcccactatgccagaaacaaaaaaaatcctggcatatcacaggaccatgaatttcccacaccaaaaggagcctccagggaagatttaaggcaagagccaggagggattatggctgccttctgatctggggccatgatatgtgaactgtgagatggacatgtgtcacactcagtaggcattagaacagaagccccagaaagccaagccacatgcccaaggtctttggctccctcatcccctgttctttccattgttctatacagtggctactcttgtccactgtttctgaagagcacataaactgctgcccaaaccactcactgatagagccacctagggtacagctgcagaagagagccctggaagtgtaacgctgcatctctgggcctgtcattatccaggtatacgactttgagaatgtccaccatgtctctggactgcagtgtagtttctataaaataacatgtaaggcctcttctatttctaagattatatctaataactctaatagttctattaaggcagataattcaagagaagaggaaggagggactgattcccagggactgagggtgtgtatctatttcaacatcacatagtcagtttgccccagaggaaattttctctgccggagacaccactgagcttcaaactcagggacttggcagctggaattctggaagtcacaactttccaggagtgcctcagtgctctgcagtgaaaaaaaagaaaatgttctccaaataaaataagtaaaatggaggtgtcaaagaacatcaaggagaaggtggctggatataaaaagatgcgggaaaaaaaaagtaaattggtgaaaagtcttttaagtaaataactttgtgtctaacttaattttttttttttttttgagacagaatctcgctctgtcacccaggctggaatgcagtggcaccacctcggctcactgcaacctctgcctcctgggttcaagcgattcttgtgcctcagcctcccgagtagccgggactacgggcgcgagccaccacgcccggctaattcttgtatttttagtagagacgggtcttcgccatgttggccaagctggtcttgaactcctggcctcaagtgatctgcccgcctcagcctcccaaagtgttgcaattattggcatgagccaccacatctggccctaatttaattctgcaatgaaaacagatcaattcataataatggataaatggtggtggtgactaaaataaagacacggctgacggcctcgccttagatgggccctttacctgcacctgaacctgcatcctgaaacactcacagaaaatgcagcacaggcttgtcaagcccctttctgtatcgggacgaccagggcaccaggggcacgaagacagcgctctgtaaacatgcagttctcctttgcctaccaggagtcattcaggtggcaagggccccgtgagtcagaagtggggagatactctgcttctctgaagccagggtgctcccctggatctgaccaggccatttatttctcagaagacactttaggtcacttctaaaggccaggctggaacccaaaatggctaagagaaggatgccaagtcccagacatgacctgccctaagaggcagctctgctgagctgtgccccaggagtttgtgttatgacttcctgggcacctgcatcatagtgctaaaggcacagtagtaagtggcactgtcttcagtccttactggagagatcaccaagtgaaaggctttctgggtcagaatgtgtttcacagaaaaccgtccttgagtaaaatctgcaccttctgatctgctgttatccccataaaagacaaactgaaaggaataatctggccttatccggtaccagaataaatctggatttgaatatacagtgtcgtaagtgcagagcagtaccacctcactgccactcgccaccgtctggtccggggaactctgggttactttgtcacacagcgtgcccctgtctgggaaaaagacaatgaggaaatagtgaattctgcaccccccagacagtgagtacagcacatgcctagcccagaagaactcaatgagcagaggcaagagaaggacacagaaataaagccaaaggcagcaaataaccaaaaaccaagagtgcaagagaaaaagccttcaagagtcagagaaggagaaatggggttatagagcaagtggaatgtaaacaaatgaaactacttacagaaaaacaaaaagctaaagcccacagtaagaatcatcttttcttcatatcagggcagaggatatacaacaaaacagggttcctaagatctcagagactatctgacggttctaatgaaagaagacgggaggaaaacaagaggagactggcagcgctgacggtcatgtgactgattcagctgtgacttctagaggcaaatgcgctcagccaaggaaactgctattgctattatgattttggccccaatccatcttgaactaacacatatgacaatgaaaaatggattacttttaaaaaagaaaagaaaagaaaaacaaaggaagggagagagagaggaagtgagggaggaaagaaaactgcaagactaatgatggcgttcttggatatccaactgctacaaaagtagttcactctccatttctgtatcctctggtcacagactggtgtactagtccattaatcacatgtcgtactttgagtgacactgtctcatagcatctagcacggctccacacactttgttctattcaataaatggaataagtgaaagagtaccttggacaactcccttactcctctgtgtaaagaggaaggaaagggggttggaccagattctttctaaaatctgtcctagacctgaattccagaaatctttgatttcagatgcttgagggagtgtcctgatcctaagtgcttcttgcacttcaccagcttgactttccatctctcactgggcccactgcagcacacacttggctccagctggaaaatcctgaacagagcttcccggcaggtgaactgccataagtgggttataagcttgctgagatagtgttcagagtgcccatgtacctggggtggctggagcccctgagccagcccctcccagtcaggagcactacaaatacagttttccatgtaagccatcaatatgacaacagttgggaggcactgctgtgaaaaacagaacactgactaactcactccccaaaatgcaggagtgttcctaggagtatttctagaaggtccttcatttccctttttccctacatccacttcatcagtaagacctgtcagttctaccatgaaaatatatctccaatccatctacttcttccatctccactgcaaccaccttctataaacaccatcatctcttacagggactgcttcaataacccactaactggcccccttgcttctgctcttgtccctggacaatccattctccagttcttcataaaatgtacatcagatgatgacagctggacctccttcccaggcctgtaacatctgcaaacgatctggcccttgcttcctccccagcctcacctcacatctgctccttctctttcttcccttcagctgcagtggccttccttctcgtcctttctatgtctctcttttctagctacctgaaactctgtctccaatttttcacagttctcagctccaactaaattagtcacccatgccacccataaccaacctcaattacatctctgttcttattttccctcacatcactatctgaaatcatcagattcatacatgtttattttatgtctctcccatctcacctctcccctacacacacacacacacacacacacacacacacacacacacacacacacacacacgataatataaactatatgagggcagggagcttatcttttcactgatatgtctccagcccctgggcttgtgttgaccgcatcacagacaatcagtaaatatctgtgtaaaaaaaaggaatgcaatttcttcacttaaaaactcaccattcacctagatttaggaaataaaaatacaagacacccagttaaatgtgcatttcaaataaacaacaaaaatttcagtaatacgggtagctgggacatgccatatttggaacacatttatactaaaaaagtattcattgtttatctgaaattcaaattccactgggcatcctgtgttttatctggcaatgctaggcatgcagaataccaaaagtaagcaccaggcaggccagagtcccaccatgagcatcttcagggcccctggatgtggaagagggatgttgagggcccaggggctgccttgccggtgcattggctgcccaggcctgcactgccgcctgccggcaggggtccagtccacgagacccagctccctgctggcggaagtccatttcagagcttccggttctcccaagtccaaggattatgctcactccccacccacagtctcttagtgtctgtccctgctctaaagatgttgtctgggcttgatattaatatgagagctgactgttcccttcctgatctagaccataaccatcttcaagttaaattgctcctcctcttctaactgcccaacctcacccacgtctgaccatacccaagcacagagaagtgggtttaatggaccttcacacagaaggacacatcctctcctataatgctttacatggaaggttcagacataacctgagtcctgcttggggtagcatcatcatgactctcttgccctggtgtccttgcaatattccttgaaaggcatccctcccccaaggaagggcaggcactgagcacagcaatgcagtataatggctaagagtgggatcccggagccagcctgcttgggttcacatcagctccggcttttaccagttgtgtgaccttaagcatgccctaactctccaagtctcaattgctccatctgcaaaatggagatagtaatagcttttctcacaggactattggaaaatttagtgaggtcacacatgcaatacacccagcagataaatgatctatgaatgtcaggtattgctgttgcatatttaatttaaatgttgccatttttattaaatagacatatgaatagagttcctaagagtgttactctcatcaatgctgctcagggaaaagatgctgagtaaatctaaattttaaagttgcaaaatctagcaaaagattgttgatatgttgtatcaatcaatggttaaaaaaaaaagactgacatctttaatttgctttcagtgctgcaagcatgtcctagagctccgtgatcccctgagacctgtgatcctctgagacatgagccagctgtgctctccccaagtccctaagagcattaggagcatgagaagtgagcattccagccccttgttcttatgtcttccaaacattgtaacaggcttgttcatgagaggccacaatgcatgatcaagtgaccccaccactgaggaataggagaaagcctcaagattcagtggcccactaaggacgtattgccctaagtttctccaacccatcttcctattggcatctggagactatgcctcttcccaaggtgctgagggtgctgcagaccccacttgccctgcaggccccacccgcccaccagcgaagaagggctgcctttcattagcccaaaactgccactcaagaggggtcctcagacaaggtgggagccaagagatttggcgaacgtcacccttgtcccacagcttggatcttgatcactcatatcactcagaagagggacttttctctcttgtttcctttgaggtgggcggctttgtttttgacattgtagcgccctctgctgctactaattatcgcatctccataaataggtcatactggaggttgatagaaaatagatcagggaaggaaaacattctttgttcacaattcaagtcaaagctgctgcttctgtctccattcccttttcaactctgagactggcagctgcttctctgttggcccaaagggactatcctccaccagtcacccaaagaggactgtctttaaggatatgagatagcaccctaagaggataaatggacattttcttgtctacaaaaagcctaatgcaacagtagaggacatagggaaatttctttggatggatagagacaagtgcatctctttcttacgaaagaatagaaatgtgattaaaaaggaaaagcctagaaacatctgaacgtgtggaaatgggggtgagtgggctagagaaaggatttctgcatcactttcttcctgtagcaattccatccgagatccctgggacagacctggcctgatgaatagcaggaagcacaccagggagggacaaggtcctgcagacaaccttcaccaccaggctgggacagcgccatggggacccagggcctctgctttggggaaagaccttgctgagggccccatgggcaagaacaagtgtgaagaaccctactatggttttttgcccaatgccctccacaaagccagcgtttgaaggaaaactgtgaggaagaagggacactccatggtgttgttgttgccaccgctggagcagcctgtagcaagaacagtcttggtccaaccaggtcagtgatactttttatgatggggctgtgtgggacctgacctgactcttgctaaccagatttctaaagccatctgcagggtcttttctcctattattccccagggcagggagggcaaacagattatatctccattatcaagagctaacaattggtagagactatgcggagcatgctggtaagaaagattctgaggccacatctatactcagaggaagagagtgatgtgtttattagcaatatttaccaagggagcagaagcaggaggcaaccccacaccattttgtatttcccattcctgctctcgatgtcattccctgaaatgagtcctgcagagaaagaataatcagagccaattctccattggattgtccttttggtaaagggcaaatttttccatttctgtcttttccatggaccatttcccctgctatcaattgctgttgcctgcagcctaagaaataaaatttttaaataaatgagaacgttctataattctctctaaaatcataaacaatgtgtcaaggccaaacacttccctggtgtgatttattcctatgtggactcatccttgtataattagcaggaataatcacaccctgagccagctggcagagcccctggggacagagaccacccaaagaaggtccttgttctcctgagtcacataaagggagtcacacaaggcgggagtggaactcaggtgtccggagttctagtcccagctctgcttctacctatctacatgaccttgagcaaatttatcccgcagagcttcagcattttcatctctaaaatgagggcattggcccaggcagctgttaaatttccttccaagtctcacattctaggatgctaatgtgtaaaattatagaactgacccaagagttattagttcatatccccctgtgcatgttgcttgaactcctcattgcccagcaggaggaaaagggaaaacatgtttcttcattggggggtagcataatttcctggttgactatgtgtgactcatcagagcctggcggtccaagcccatatgccatttgaaatccggttattattacatctgggagagagaaaagtgctgaaaacagcctttgggacactatcgatttggccaaaaaaaaaagaagaagaagaagaaggctctgtctagtgtgataacattttgttatcttattcattgtcttcatccctgaaatacactctgctctctcctatctctgctctgaaaggcagaaagagggcagccctctccaaggcaaaatggggctcctgtggggaacagaggggtgcctctgtcaacaaaggtgatgccacatccctttcaaccatgctgacacctctggtttttgtaaaggtgcccactcctgtgggtaccgggttaataggaaactgacatttggagccaacactagaggaatcatgaaactcagcaagtaatatttggcagaatttttttttctatctgaaaattatcagtgagagattctaatgtgccttaacaaacaggaacaaaagatgagtgtttaatacaattcaatttaacaaatatttattaagagcctacagttattcccatggatcatctgagtcagtttccgaggaaacattatcgttgccttaagggagctggggggttgtcaacgggccagaggtgggatgaaaaatgacaacagatttacctctgggaccgggacatggttaaccacagcggccctgggtaagtagcttagcttcagaagaaaatgtgcccaacagcatgggtaacctaaaacaccgggcaatccaaatattcttttatgattggctttagcatgtattttattcttttgtagggcaggtttatctcaccaattatatattttcttaactgacctgtaaaatctacaggggaaaagtattttaagaattatatgtttctgcaattaggctcccagcagtcaacaaagaagtggtactttttgtctttccagtgatgaaaaagggaacctggcatccctggtggcccaccagcgtctccttccctggcctaggtcagaacaagccgtaaatcagcaggccgttatcttcttataaatctgtagagcagggtggacaacaaaaggcagcctgctaggttttcagaacatgagttccttgtgtagccagagaacctgggaccatcctgacgtggctggtcctgctgtcctcacagcctgaatcccaggctgtatgaataggagaggttcaagtccagatgactgttcacgatgctggtcccccttgcatccctaatcatgctagagacatgaccagggtctgagaggaggaagttacagcacagcaccaacaggggcttttggtaaagggcctgggcactatgtgaagatcacctagatgctcaactttgggaaggggactgagttaattgtgagcctgggtgagtacctcaactccagaggtagctttagcggaacccctctatacctaacacctggcaatcagagggctgaaacacttggccagataatgaattctcttatccggtgggaaaaggctgtaaagatcaaaccacctttcctatgggtaagcaagagtctgtagtttatgtaaaggcagcagctcctgtgggaaggaaggaaacaggaaatttacatttggaatggggacgcaagtgagagtgaagctatctttaaaccaaaggtgtcaggttatttggtttggtttttgaattatctggaagttccaaagaaagaacacttctccctgaggatttgattgcaaaattctgacttcaaacttctaaaaagatcaaatgttaaatcagatagtaggcttggaaaactctatttctctatgtaaaaagtagagaactacttttcttttgtttgatcattttattttgtttaggaaataagaggattagataccctggtggtgagtggggagggcagggacatttgcacagcatttctggataaattagatccaaataatcaaatcaaagactctcagctcagaaagtaattaaagatctcctcacccacctctttaattttgcaaatgaagacagtgaaactcagagaggttatgaacttgctcaaggtcacacaactgatcctgatatcaaggtccagggcaaagccaagacagctcatagttctcaccagcccagacccaagggagaaaaaaacatcatagtccttggccacggcagcatcatttgcatcccaaacattctttacccaagacttaatgaactcaaaaagaaatcctgagttccaaagggaaataaaatcattctgcgtctgttgaaaaaaaaagcaagctaaagtggaacaataattgaacttgatattaggggaaaggtgcagccatctgcagactgagagaagggtgaaaaaaacaaaatgaaaatgctagtcttgtgttcagacaatgattatgaccatagaacactacctataagttctgtagagctaatttctttcccagtggggttgatattctatgatagattgcatcagcggtgtgattgttttggaccatagaatacgtatacagaattggcttgttgagccttctggtgtcttgaagtgaaaatcatatctctggacatatctgtcaggcctgaagccctaggctactggaaagaaagataccatgacttatccttcctctaaagcttagaagttggagaaaaattctagttcttgggaagctctgcaaagcagggttcgttaagctgatgccacaggtttttgcaaagcccctcagcacagtgtttaagaaaccagtggctctaggttgacctttggggaaggaacacagctcacagtgaatcctggtaagtggaggggagcattgaatcctctgcctgaatgtatccattttatgccaatgaattgagatatggcttcttgccccatctctgccacattcaagtcctgcttggctaaacaatgctcacggatgtgcacgtgtgcagtgggatgcagctttttctaacctctcacaaaatcacgcaaccccttcaccaaactgcttggtggctcttctgtgccctcacagcccttctagtttagcagttagaggaagacaagtgcccaagggctttctcatttttaggtcattgtggaaagaggaacgttggtgatatgtttgcctgcttgggaggaaaataataatgatgatttactcattggtttctatatgctagttgatgtgctgcattctttctcttatcacatttaatccttataccaggtctgtgagttaggtgctattattatcctcattttatagaagagatatatttatattttatatttctatagaagcacagagatgttgaataacttgttcaagccgatgaagtaagaaagagaacctggagtttaattcttggcactcagattccagagctaaaagcttttcagtgaggggattatgtctagagggaatgtccctgatgctctagtctctaaggttgctaagataatcgctaaagaactgcgctctcagcaagtaaagccaggggttggtcaacaggaccacggtgacccagttacatattcttaatccttacaacatcatcaagcagttgctgttttccccactttacaagtgaggaaactgaggtgtagcaagttaggaaacttgtcctgagttttaaactcaagcctacctgccccaaagcctgagctcttttaaattaactgcaactgctgaccagttagattaactaattacttaattaataagataacaacctaacaggctgtaaggtaaaaaagtaatcagatttgttctataggtcccctcccttttcgggaatagctatacaattgtataattttatgcttcccctgggagagtgggtggagccctggctcccagcccatgatggaagggtcttggcagtatttgtaaagcagtctgtgggggtgtaactcagggcggatctgaaaagctggtctttggaaagggaacgaaactgacagtaaacccatgtaagtctgaataatgcttccaaatttctccctggaaccctgatttccaaattttccattctgttttataacccaggtccaaaccacagcagtcccattaatggattccagtgcaaaacaactgctggtgtattcctactacacgcaggtctctgttgtttgccctcatgtgctattttatctaatagctgagaatgacagtaccaatggagcactgagttaaggagtcagactgttcgaaggcttcattcttcgttataattggtgagattttccatgggactaagagaaaattgattaactctctgagcctctattttcctcctctgtagaatgggggaggcagttcctgttcccattttaccacagccggcgtgctgtgaggggatgttggtacatttccaataaggggacaatgagtgtgaagagaaaggaaggccccaggtggtccgtaaactcttccaccagtcccacactataaacagctggttttatcagggggattcttggatgacaagtaagcacttaagtaaatatcaaggggagtctgggcaactgagtttttgtagatcctcgtgtcattgtgttatactggagccaatagtaagctgacatttggaaaaggaataactctgagtgttagaccaggtatgttttaatgaatgttatttgtttccaaacataagccaccatccttagaaattcagtgaaagataaccgaatctcctgcccagttattagcatctttcaccatgggtctttctggagaaaatgacaatgtgggcagcccctgactgcagcccctttgggactgtttctttaacacctttaagtacttgggaatgttcagtgtgtttttgttaatgttggagatatgtgtctgacaaatggaatctgaattgaagttttagtgtgtaggggcagaaagcatttagaaaggacaaaagaaggacagattagactaaaatacataccaatggctgggagtatgcaatgcaacccaatccaaaaggaaacagtgagatgtagcctgctgattaaacaactgagccagcactccgtgtcagctgacttgtcttcccaaagcttccatgttggtgcaattaggaaaagaattgtctaatccccataactcaaaatcttggagccaagctaaattgggtaaagccgtgtaagattttctggtactgacactgactacaagctgatatttagggaaaagttaagattgaaagcaaatattcaaattagtcagaaagaccacgaacttctgaaaacaagccccagggtgctgttaactgctgcatttctaattgggtcctcatggaacattttcatctctgccttgtctgagctttctgcaccagagaagccccttttgatacccactcacttctgagtccctcattgaaaaggtggcaactaagcttagagaaggattccctaatccaaatgcaatacttgggggaatattttgagtattgctccaccattctcaaaacaaacctaatttcagttaacttgaatgtagctgaaattttgttccatgagggaatctctgctttctatgataatgcaagctcatttcaaacaattgtttgggatttaacttttgctcataattcccaaaagataccaactattcaatgagtatcttaaaataaaactacttttatgaccaaattattatccccattagaatggctagaatcagaatgtcctagtatgtattatgtgaaccccatgcgaccttcctaaagtttcttatgcctaaaacagcataagagagaaaagcatttccacgctaacctgtgtgttcactggttaacaaaggtctaaagagcaggtgagtcagctgctccatttccaaactggactggacatttacagtcctgcagatactaaaaatgataatcaggaaaagcacacacaattctactttttcttataattcccatctttcccaaagaactgttataaattctctcccaaaggtgttatattcatccttcttttgttgcctctatttgtgatgtgtactgaggtgaaatatttgttgagattcaaaaaccccatgagatttaacttaagctttccctgtcagagagattctaagagctaaaagatgggaagctggtatttgggaactagattaaaaagaaaatccaaattaatcccaaggagcaaggctcaatagatagttatttagacataacatgtccaccctgcaagcctagttgctcagttgactgggctgcccctatcttagtcttgcctggaagagaaataagttgtttgccccatacctgtcttgagaaatgtcagcctccagacctgaaagcttcttgtgatttggtttatttctgtagagtttattattatacacagtgttcttgaagtaatagagaagtgcattagaagctcctgcaaatggaaatgaaatgtaaatttagattgtaaatacatgactgcggtaaatagatagcaagaaaaaggatgaagagattagaaatttgccacatttctctaaccctaaagggatgtttctataaatagtttaaaactgttgaagacgaagggggaggaggaaggagaacagaggcaaacagattttctcctaatcctttccatttggcaaaattagaaatggtttttcaattaaatttccctgagcagaggaagaaaccatgtctgtttccacactaaaattcctgtgggtgggagtctctagagttgatttggaggatggatccctgttagtgacaagtgctggtaatgctcctgttggggaaaggggatgagtacaaaaataaatccaagtaagtgtggagggacaagaagatctcacagtgcaggatttcccctggattttctgcattgccttttcacctttcctgtcttagcacgacaaattaggtcccagatgagcaggccctcgcattcaaaccggaaattttaaggaggaagccagattaactttactcgggagacctagtagactctgactttaaagattcttttaatccagctgtttttagggagagctctgtaaaagatgaaagaaatgttttaaaaaaaaattaaaattctgtggggtgaaaacaaagatgttaaatatttgattggcaaggcaactggaaaatctggaccatgtctacaactgctaaaggaggctttgtgaaagagaaaatgagcagcccaaggagatcctgtcctaaacttctctggccagtgaaattcgggccattctctgccacagccctggactgctaggagggcagatcatatgtcttcctcagtggggagaggtgggccctcgctggcagtttctgtaaagcctcgtgctgtggtgtaattcagggagcccagaagctggtatttggccaaggaaccaggctgactatcaacccaagtaagtatgacagggtgaagctacatgcagctgagtacagtcttttcctttctagaccgtgtcctgcaagctctccttgagggacgtatactcattttgcattgtcctttgtagagaagcagaccaggaaagacaggaaagccctcaaatttccacttttaaacacctccctgtaaaaactgtctcgcttccctccccttctacaatcagtttctagtaaatcagaatccggtgaattgatatgcaatttcaacgaaaaaaaaagcagagaaatagttaccccaacaagtgcaaaaagtagaaactatctgagtaccagccaagggaagataattaggaaagaaaaaaaaagaaagaaatggattactggaaccatgatggcagcttagtcacaaagaaaatgataaaaaaaaattaaaattaaatttcaaaaactttaaagatatatacatatatatatatctatatatatatgatatattgtcctctggaactccagcactcacctacagcagctgcattctggacttattatcaaataacctataaacctgtagcttaatgaagagttgagcaatcgtgactatattgacccccaggacccttctgcaaagagcagcttctgttcctgtttctgtaaagccttctgtggctgtgagaatagtggaggtagcaactataaactgacatttggaaaaggaactctcttaaccgtgaatccaagtaagtttgaagggagtgggggaagggggaattcaaacacttctgatttaattacttgcccctccaaaacattccagcttaggttccaaatctaatgtttgtgctggggggatatggtgcccatcagagggattagaactccactgtacaaagactaaattactttcagcccaaaacattcctatcattcatcttaaacaagattattggtgcaaggagaaaaactgaatacagaatcctgagggatccagctaagggtcaggaaatgtttgccgaaaagataaagaggaaattggcatatcgtgactacgcaaatgcagtagaccaaatataaattgtcctgacttagatactaacactcctcttaaatttatcgcctgaaataatggaaccctgcaacttcattaactaatgctgaaaattctataagcaggctccttttcttcttttaccttcactttacctctctgaaaagaactgttctcaatccccagtctggtaactgaggtccagtcagttaactgtctggttaactcaggcagagcatttaaccccactttttctttggttaccaaaatagtggattcagcctccactttacttagttcacctgagaaggggaaaattcatctgtcctctgagtcgtgagaatagagcagtacattctctccttcaaatatacacccacccttccctaatggtaatgtgtgagtacttagaaaagtttttaaatgttagatataaaagtaaggcacagtggttgctaatggcacttcttgaaaatctgcgctgctggtggacttctgaaagtggtgcttataaactaaggctggagaagactgacttgtaaaattcagataaaatgaaaatgggaaaaacttatcaaagggccccggtctcctaagtgccctgatgttgagtaaaggccaaatgccccagttttacttactcagatctgctttctgtgattaagaagagatgcacactagagagaggcactttgaaaaacacagcccaggcaaaattcttaaaaagactggctctggtggcggggcgggtggtgaaggactcagggacaccgtgcatgcagcattgagggagttaatgcagacttgctagcagacagcttggaacgttctgggataggccctgcctgaagaacatgcagtgtggttagccatcaagttcccatgtgcagaagtgccttgctcagcaggggcaaaatcagcacgtctgtggcaacagcaacaatgaataatatatgatgttaaatcccaggggttcagcagtctccactgaggtcttatcaaattaaagcttcaaggggattcatatgaacatcccaggagactcaaggactcagtcgcttttcagagggtgggcagccaatgctagggaccagacagtaggcttttttctttggtttcttaccggaagcacactagggcggggctctgcggtgggttttccagaatgcagagaagctgggagcccctctcagcacttggtcagcctcttaggggactgagaactgtaacaactcctaccttttaaaacattgacgaggtcagggtgtttgacagcctaaccaggcaaagaaaatatctgtgcaaggctagcattcttccagagctctggacagtaatcgtatgccagattttccatgcagtggattctagctgcaggaactatatggcaaggctggagtccaaggaacccatgattaaattctgttttcctgcagtaagtggaacacagagattattgccacagcaacactttgggtgcctgtctgtttgaggacctcagctgagggcaggcatctggttttgcttatgtcctgcggaggctgaagagagggtgggaagccctttagacagtgaatactgtgaaatagtgaagagatgggaagggtcgtttgaatccctgactgctgtccttaaaaaaaatggatacgtcttcttagctaaataatagcctttttctctcacccttttcatgatagtaagcaagctaaaactttaaccctttgtaacaagtggttgcttgaagacatgactaaacaggctagcataaattcagcccaaaaaaagtctgagttaagaaaactaaattctattaaagaggtgtctgtttttcacacccctgggggacagggtttgatcatcaccacatcatgaaactgcctggattttgctcttcacattttttgtgacatccagacacagccagggtgactcccaggattcctgtggttgtgtctgttggcaacagaagcattatttggtcaagggatgaaatttacaggaaccccaagtaaatgtgcaaaagcctgcccctaatagagacctcacttaaccctaccactgtggtcaccgggctgctctgtgaggtcagaacacctcaggtgagactgtggagtaaccagatgtcctggttttcctgggtttcaggggttttccaggacaaaggtcattctttgctaagcccagaatgatccccaggatagttaatcaccgtaagaaggcacagataaaaacttttttctgtgagctactacttacatttcaccaaattcaagactgacaaaaaaactacgttgtgtgaaagctcagttacatgtgcccatcatttttatttcttatgctagggcatgaagggaagctcaggagatcctgtttcatgaggctacagtctaaatctcatctaattctagtcattctccaaaaagctgaacactctcctcttgtctccttgtaatcaattcattgtcatcagaaatgtgtgacacctcgaggggaggggaggacgtgtcttgaaaactgatcagagaaattgtcctgaaaatgatgctgtaaaatggaaatgagacctttagaaagagagatgctgaacatgagaaatcagtaagcctcaagacaaaaaccagaggaaatggagagagatgggaggcaggaagccggacctcgggggacgcagcaggtcagtgtcccaggaccagaggtggaaatggtcttccagcctttggtgggatgaaactgagcctcacagacccaggcccctttgggtgagtttattctccccagaattaaaagaggaggaagtctgcgagcttcagaagtccccctagggttcttgtaaaggcctccagtgcagtgctaatgctggtggtactagctatggaaagctgacatttggacaagggaccatcttgactgtccatccaagtaagtgtaacaagacacagcagtatactggaaattctggaatgtcaccccagtgtcaggttttaaagaaccagatattgcttaaagttaagtggtgtcctctgaggtcctttctcttctttaacctcaatattcacagattttcttttggaccctgagttgttaggtctgtctccctgctgcgtgtacagctgaccttgaccctggaaagtcagaatctttcctgctttcagtgtcttctctggaggtgatgccctaacttttttgagggggaggtcatcctttccaaatgactcccctgagtaacctgttctaatgtttagtagcattccctgtcagaagtccttccttacctcaatcttaaattattcttggtatagccgaggccgtttccaccagcatcatccacaataaagaggaaaattgagagcggagtttgaataggtatgtggtatttggttcagaatgggttttaaatgaaagtggagagggaaaaaatgaaacctgaatgggaatctgaggtcttatttcaaatccctctctgtttcctgtctgtcatctccttttgcttctatagatgcaaaactacagagagagaggcggggagagaaaggatagacagaaataaacatccactgtgtccattccctgtcactgaaaccaccaggcaagggattacaattaattccaaagagtttcagatacacggcttaatacctttctccttgtggtgacttgtatcctggctgataattagagcagatagaaagatttggctttggtgtgtttgccgctgcaccccgctgggaagagacagaaacttgactgttttttaagattcataaagttccttctgtcagtcgttgtaaaactccctgaagcagggagatgcgtgacagctatgagaagctgatatttggaaaggagacatgactaactgtgaagccaagcaagctggaaagacctaaactcacagtgttccttatgtacttttgctcccttccccgtttcaggccttttggctgtttcctgtagggattctaagagagtcaaatggaaatggattgaagagagtctgaagccccgtgggtgctcagaaatgataaatgaaaggaataagagacagaaagggaaacaaagttgaaaagcaggaatatgtctttcactgcagcttgataagactgagatgtgaggtgggtgtcagagaagggcatgatcgctccagctgctattgcagaacactctgttttcctaggatctctatcaagggcagtgtcctcttatgccaaagggatgagtcaagtccctatatttctggagtagctgcccttgtgcaggcatagttggtcaggcagacagcacaatcccagctcagtgtgtatggaggaggccacctgacattgccagctgtatctgctccattcagtggcagcataaatccataccaggtgggtgtggatttggaatatgccagtgccactacaaggctgaatgttgagttgttgtgatcatcttgaatgtgtgagatgcctccaagtgaagtctggttctaatgagcagggtgcaggttggaccaatattgcccattttctgttgagtttctccaagcccagtagtgtgggagccaacattgagagactgacatttgagctagggatcctattgactgaaatatgccaaagggatctgaaaggtcaaaactgccttcagagctcagcctttgttgttatctctctggcagttgtcatttcagcaaaatgcatccacttagaaagctcagctcttcattaggcagacaaatgagaacaacatattgaccagagataaggagttgggagcccagatctcagcctctgagagcctggcatttccagttctttaatcacgtgagccagtgagcatatgctatctcagagaaagcagatcaatggtgcctgaggacctggtgtcaccaagctagggcttagagacagaaatgagatgcagatggggatgttgtgtgaattggggaataatagagaagtgaggaggagacagggagttcaatgatgctttttaaaaccagcagcatgtgagaaattgtaatgacacaaaggtgaagaagtatgtattgcatataatcctagcaagtttcctaccattcccaacagaatctagcctcactgtggctccaactcacagatcctataggtaatgctgaatcttacctgagatgccttttgaagtggcatcaagactgggctctaaaatctttaagagtcacctgtcagttattgtaaaggtttggatggctgtgtgaaaacctcctacgacaaggtgatatttgggccagggacaagcttatcagtcattccaagtaagtgtccctggggtgctgcctgtggagtgcgctggggctaacagtctcatacattagggcttaaatgactgtgcagatggcatcgtggttgaggacacaaaactgagagaatcgagatacattgactctgatcagaaaaaaaggtcacggaatagcaaacataggtttagtccttaaaaggtagcatagataacatgggacttgaacgtggcaatttgaaaaacaacctgtggtctatcagcacgttctcactgcacacgggggataaacaggggtgggggaataagcaatggacattgcatgataggggtgctagggaaatgaggcaggtcaggaagaaggaaggtgatcagagcctcatacggagttaatctagagaagatgaattgttccataagtttcacaaagaaataaagtccaaagatataataagaagtcctgattaaaatccacttcagaatcatatgatcatcaggagagaaattaagtcttaaaagaaaaagaagtttttaaatgtaggtccataaaacaaatggacctacacctttaattagacagcaagcagcacaagatgcacgttagccttccttttaatcccctctcaggaggaatcagtccctccagctgcacatggtcacagctgctctaagccctggagctccttcccagtaatacccttgctcctgtgcctgcacagggaaaggagatgcctgcctgcctgcctgcctgcctgcctaccggtctgccttttggtccgccgcttggtggggccccaggtgtaacctctggctgtctcttctgcctggtttttgttgagcttcctatcacagtggaacaccggtaaccagttctattttgggacagggacaagtttgacggtcattccaagtaagtcaaagaaaattttccatcaccattgtgttgagcaaaccctttaaactgcagaaagagctgtcaaagtctgctactctatttctctgcttctaggtataactttatctggaccagagtaaagaggcccccgacccaccccgagaatgatttatgcttggacaggtctttatttcattccttgaactatctatctgtctatctatctatccagctatctatgtatctatctatctatcatctatctcagaaatagttgtttttaacagttgattctgtgcctcacccaaattgtcattaactaaatgcagatgtgctgccacactgataaacttcattggaaaaaaagaaaaaaccaaacccagagaatgttccttgaacattcctgaagtgggggggcaggcgatgtcacttgcagtgacagctggcctctctagctcacccccacatctgtgccaaccagagaagctgggccctttgtagcacaagcctcaggagcagagaatggagggacattctcaactgagaggagagggactaggaggctagatgggaaatgaggtgactctacagaaaatcgaatatgggatggtataaaaggatgagaaagatggcagggggtccacgatcgctcttgtatttagacctgggggatgcactgatagataccacctggagagagaaagaggatttctgtttccctctgaagaaaaatgtggcagaaaaatcaaaacagatcgcacatgtcaagcctctcctaattacagcctttcattctggtttctctcagctgttccagcaggaaatggtaggaaagggtcattggtgcctttgatgttgtggaagcattgcaggaaggagatttgcaagaaacggggcaggggcttgcagtagagtctggagagtttagaatgatggtttttgcaatgacttagaacactgtgtatctaactttggaaatgagaaattaacctttgggactggaacaagactcaccatcatacccagtaagttcttcatccttggtcaggaaatcagcctgcataagattctggggatcatagtagagatgcaggcttagagaattttcatctgtccttgttcataactggtagagacaggtggcagccaaatatctgagttttccgggggaactccagtcctgactatttaattcaaaactagaaaatatgattcacaattctgtttttgctgctgccgtcaagtgctaatgtggcatgtgaagagaattcaggcagaatgactgcatcttcactttcatcttgtgtgataattttagctttgagtactgcaagtgtttgggagaaatggtagaaacatagaatatcaaagagacaagcaaaccaagagacccagagaggcaggcagacggaacgtcaggcagtataattttacaaaactaattcagtgttgtgtctctctctgcaaatggcaaggtatcgggaaaggtgctaagagctagtgctccgggtggggcaggattatctaaatagaaaactaagcactgatctcagggggaaagtttaaacttggaaatctctgggtttggttttttgtttttttccaatgaagtttatcagtgtggcagcacatctgcatttaattaatgacaatttgggtgaggcacagaattaactgttaaaaacaactatttctatgcagccataaaaaatgatgagttcatgtcctttgtagggacatggatgaaactagaaatcatcattctcagtaaactatcgcaagaacaaaaaaccaaacaccgcatattctcactcataggtgggaattgaacaatgagatcacatggacacaggaaggggaacatcacactctggggactgttgcggggtggggggagtggggagggatagcattgggagatatacctaatgctaaatgacgagttagtgggtgcagcacaccagcatggcacatgtatacatatgtaactaacctgcacaatgtgcataagtaccctaaaacttaaagtataataataaaaaaaaacaactatttctgagatagataaatgatagagagagggagatactggatatatatacacagttaatgacaatttgggtgaggcacggaattaactgttaaaaacaactatttctgagatagagagaaagagagagatactggatatatatacacagggtagaagaatgtagagagaaacatgggcaaatatattcttttgcacctacaattaaaagctgtggaaaatttgaatatgttcactttgtaaccaaagacaaccacacaaaatggaacggaaagcatgcttgcaacagcgagaactggaagtatggaacctttctgtcttaaccactcagttgcctagaagaatcttttttctattttgctgcattagaaattaaaggcatgagtattgaggatttgggtaggtcagacttttatagtgacaatcacattacaaagcacctcttagctaggttggataaagcacctttaaacatcaaagtctttttcttctttctggatgagatagaaaaatggtctctcctcactctgtatctaaggacagggggctcagagagttccagacttacaaagtgagactgcagcagagctgagccatgggacctggagggacccagtgacggttagtctgctccctcccacgggtgctatagtagccacaaccgttcaggaaaccgtccccaggtgagaacgtaacacacgcagggaaaatcccactgctactaagagcaactcagcataagaatgcattacccagcaagggacagtcagaggggctctaaaccagagccccaaatatttgaaaactttatgtggaagccagctataacaagttcgttttccaagccgtgcttccagaagctgttagtggttggtagttgctaagggttttgaaactggaggacatcatagcagagtggaattatttggcacaaggggctatgattagaattaatgagatgaaagaaaattctggctagaagactagaaaaatccggaaagaaaagatacagtaaaccttgggggagttgtagcatttatcctagtccaagcagcaaagagcagacagaagccaaattccaataaacaattggcctttttacttttacaagtttctgcaattatcacaatgtcttcagcttcttgggcaaatatcaacaggtcctaaatgcaaagtggaacagtcctctgtttccagaaccgagtagcttagccccgccccacacaccacccatgctcaaccactgtttttgtagaggagtttgacgctgtgtggaatatggaaacaaactggtctttggcgcaggaaccattctgagagtcaagtcctgtgagtataaaacacactcaagtcccaacctgggtttcattgcatattaaataaactttttctggctgggaagtatttgattctaaagaaaggaaaagtgaaattccaagcgcaacgcaagcatttcattagtgtgattcattaagaatttccatgggttgccttcgagagcgttaatcacatccattcactggtgagacccacagtttgaaaattgagttaaatttgaaaaaaaaattgtcaccatctctgtagaccacagtgcttgctgtttgggtgtctagacttccaaaatggaacctcaatctgtagtttcgagcttggagatttatcccgagcccgtgacttagagatgtgtaagaaaagctgcacactgctgggccttgtagggcatttgtgggatcagtgtcatgaaatagcctgggtagacaggttggtgaggagacactggtgacaggtgtctgccctgtttctgtaaagctgctgacagccgtgagaagaaaagcagcggagacaagctgacttttgggaccgggactcgtttagcagttaggcccagtaagtctgagcagaaagtaagatatttatgccttttcctattatttgttctagcctgacatttgagttgtcctcctttggattccagatcaacaaaccatagtgtcttttcatactccttttaatatttgtggctaagggccctccgttcttcccatctgtcctacatgagggtcctgtggccaggtccacattcataaagaagccaacagtgatgcagttggttggcagtgtgtcaagaaactgcagtcatcatctccagggcccttactctggttatgtgtgtttcaagcttttatgccagcaacagaggagagggagaagtgaccagtagcaatgaccagggctattagctgtacctggtgtctgtgggtttcagagcagctgtggaggttacgggaggttcagggcatgagtttttctggcagaggagtttatgtaaagggttggcccagagtgtgtattcaggaggaggtgctgacggactcacctttggcaaagggactcatctaatcatccagccctgtaagtgcttttgcctgggaggtggggttcaaaatgcagtcctcatggggacatttctaaaccttggctcatgtgcttctggtgccactaccatttttggcactatcctacttacatgggaggttttgagccatgtagacaaggaggtgatgcagtttgtgctttggaggactcctgagatctgccctttggcaactgtgtttgagtaggagtccctcattggaaaatctggatgccagcagacaaaagatatgagcttaggatgggtcacaaacaaatggaggccactttgccagcagcacctttgcaacgaaaattgctttcataggaaatgtggaaatggctgtgtagatagagatttggccatttctccttttctgtctttataccctcttctctgcctgacttagggaccttaaattagagcagttattaatcatttgatttctcggccccatcactcatcaagtatgacaagagggattcattaagataaaacccagaaacagaaaggacaaagaattcaattctcaatgtcttcagagttgaacttgacaactcctcagccttaaccatctagtcagcaccccatgaccaactgaggtcaaagagggcaaccagcaggtaatgttagtcaagtgagtatctggccagagcccagctgccctcataggaattaatactgtggagtttgggaaagggaaatgcatctgtgagggctcacccaggctgcccatctgggagagatcatggggagagttctgagtgagggagtgaacaccagatggaaagtcaagcaacaggtttctgttatgaagcatctcacagtgtaaataccggcactgccagtaaactcacctttgggactggaacaagacttcaggtcacgctcggtaggtaacagaaaccgtgaggtaacttaactgtgtgttcctttaaaacaggggatactgcagaggggatatcctggctggatgtagtccttccttccttccagtgggaggtgatctcactgaggacacatacctgcattcagtcagttcttgtgctatttttatacctgttacggaggctttcctttccacctgtgaaaacagaacctctctgctccaagcttcttcagtctttattaccctatgtatttcctttagaacagtggtttgggaattaatttatcatcaggactttgtctctgatgatatcactctgggcaacaaaatgaaagggctctcaaatagagaacagagagtcctgaatactcggataacttttccagagtgatatgtgttatgcgtaatgggatgaagtgggctagaatgaccttccaatgactattttggagacacactaaggaaacttgcttaacatcctatatccttaacttgttagaacattggtgaagtaaagcaaaatcttgaccctctaagaacataaacaaatgccaactcctctcccccaaagcactgccatgtttcattatgtgcaattatgaaacaaatacatgataatttatatgaaattacatagatgagtagtttgagtattttgacccatgagtaagatgcaaattgtagaagttctcaggtagttcttcataaaaagttgtccctgaagacaaatagtgtacctgggcataatttgtttgcagtgttggtttatgcaccatttggggacctgtttgaaagctgattatgtcccagtgtgccaatttggggtctcaattaactgtgctcagtgcactgataagtgcccatatttacagtctagaagcatgacaaaatgaccccatttctgtaggaaaaggagaatggaactgtgtgtggcgtggtacttgtcagtgctgctcccccttgtccctgccatgctgggaggtggctgcaagttttccccaggaggtttttgttagagcatgtattactgtgacaataacaatgacatgcgctttggagcagggaccagactgacagtaaaaccaagtaagttgggggaatgggtcaatcttaaaagctgacctgagtgagcaatggtgctgttctgggcagtttctgtggggttaagacactgccactcccaagaggatctaagtacctggtttctttgtgcctgagaccctgagctggttggaagtctgttagttgatgaattctggcaatcttaaggattaggtcaagaagaagtagaaaatttcactggtttcttcattggcttggctctggatatataaaaatgctaaatataagccgggtgcggtagctcactcctgtaatcccagcactttgggaggccgaggcgggaagatcatgaggtcaagagatgcagaccatcctggccaacatggtgaaaccccatctctactaaaaatacaaaaaattagctgggcatggtggcatgcgccggtagtcccagctactcaggaggctgaggcaggagaatcgcttgaacccggaaggcggaggttgccgtgggccgagatcgtgccactgcactccagcctggcgacagagcgagactacatctcaaaaaaagaaagaaaaagaaatatggctgagaaagtggcatggtgctcctggtccctaaagtagcccctgggacctcaatgttgacctcctgtgctgggtgggatgtttctgcccaaccttgctattgtgcctctggcacaagcattctgtcagaacccagtgtcctaggaacaaaacaggggatttacgatcaagttcagatctatctgcacagccagctgttaattttagagaactgtcctgaccttgcaaaggaactggaaacagaggctgcaaggtggggagacttccactagaggggaaggtgatctcacttgctcagccttcccctccatccttcccacctgttgattattgtaaagccccataggactgtgtgaattatggaggaagccaaggaaatctcatctttggaaaaggcactaaactctctgttaaaccaagtaagtgttggggattcaaagtcctgatttatcatcagtactttgtcactctgggcaacagaatgaaagggctctcaaatagagaacagagagtcctgaatactcagataacttttccagagtgatatgtgttatgtgtaatgggatgaagtgggctagaatgaccttccaatgactgttttggagacacactaaggaaacttgcttaacatcctatacccttaacttgttagaacattggtgaagtgaaaacaaaagcagtaagtgcaactaaagtgcaatgcagagtgagtgagaagagacttaccaactcctttctctgtgatatcttccccccaccttcacccttgaaccccacagaattgtttctgtccatgcccctggctgttcccagtccagaccagcacgtcgttctgctggacataggaaaactccagacttcataacatgtcacagggccccctccctcagatggcagatctcaatattgatcacccacatcactgtggggagtggtgaccttgtcagcaatggtctcatggaagagggaagctttatttacaccatcaagggcccatggatgacccacagtctgtgtgactgctgtgtgattggttttcagacattagctttaataggaatcataggagaagggacatggtggctactgcaaggggttttttgtttagggagaacgcactgtggaactcaaattccgggtatgcactcaacttcggcaaaggcacctcgctgttggtcacaccccgtgagtttttgtggtttactaattgtcctctctggaaagaaatccaatgggacctgttgaaacacagctgaatttaattgctatgcttagcatgcagttgttaactatgtctgatgtgtgagcaagatatgaatacatgtttccctggaggctggatttggttatcaggtctcggggcagtttgataaattgtactaatgctgcaatcactgtttttcaaaggtccacaaagcacgttgtggctttgggaaaggcagagataagaagcaaagctttgtgatagagacagaaacaaggccatgaaaagggaagctaccaaagcaatggcatagccaaggaagtgtgtcctcaacagataagtggcaaggaccctgttgagttgatgcttgtgttgtctggtagaattaaaaaataagatgagtgggctgggcacagtggctcatgcctgtaattctatcactttgggaggctgaggcaggtggatagcttgaggtcaagagttcaagaccagcctgatcaacataatgaaaccccatctctactaaaaatacaaaaattagccgggcgtggtggcgggcacctgtaattccagctacttgggaagctaaggcaagagaatctcttgaacccgggaggcagagattgcagtgagcctagatcgtggcactgcattccagcctgggtgatagagcgagactccgtctcaaaaacaaaaagaaagaaaaacagaaaaataaggcgagtggactgaggactccagtgaagggagggcagcaggagttccaagcttggcatggctttcttcctctacgagaatagcagaacaatgtaactttctctagagagagaacagagcccttgatttatcacatcaatgcttctgtttaggtagcccccttcctcaccgtagggacaaagcaggcccccacatggacttcacccccttaactaggctggccaagccaaccctatgggagaggcagagaatcccaggactgcagagggcctccccatgtccactagattatctgtaataaaacagaatatttatccaagttgtgaagctgtgagggagagggtaatcgtgatagattataaaaagcaatattgaaaattatacaagctgtctccacacttgcagaattcagtgtgttttttgttgttattgggtttttttctgttagaattacagaaacaggggtgctttcctgcaggcaccctgtttgcaaaaatgtctgccatctcacatttcagtagtatttcatcaacaatcttctgcacacgaaccagctgtgacaataaggtaatggggctgatttgttaacaaatcgagtttatacatttcaatgagtggcctagtcaaaacactcagcttgaagcatccaacactgtccattgctttccccctccctgaaaccaccctcaaaggccaaaacactttctttttgtagcatccatgatggctttatcttttaaaggtggattttactcttgataatcaaaatcctttcagaaccaaggctattaaatagaggagagaatcgactagttactgatactgttttggatccaaaaatagatgtaactataaaataatgtcatgggtttgtttatgtggctcataaactggctctcggggggaatcctagatggaatatttcagagggttcaacagtcatttagatgcttaagtcctcatatgttcactaaatcagactctttaattaataaacatgcataaagatagcatgagattgaagaacttttgcaaactcggacccaatagaagcagtgaagactttctgtatgaattaagatataatccgaaataaattacttgtagaaaaatacgaggtcaaggcctttcaatggggaaagtgcatgtaatgccccttttattcatggagagtaaagctgcttccataaatggtaacattatgttggtttatgtagagacacataacactgtgactacctcaggaacctacaaatacatctttggaacaggcaccaggctgaaggttttagcaagtgagtattacagacaagacaggctgtattttaaaggttgttggtgttcatgtttgagggacaagggaaggtaggacaagggaaatacccatgtaaactgtgcaagctaaaatcactgctatctgaagcggcaattctgggtccctctactctggacaggaggggcgaaggagagctctgaggcttaccatgatggacttactgccgatttcataagaattgtatccatcattagcaaaatgtttatgacttgaaggcctcaagaaactcctgttaacacaacaggagttctgtgttctttattcttttaaaactatattctcactttacatttttcactcatttttctgcctttttttatgcgtctctcctctgtgcaactcaatgcttcatctgggcattcatattttgagaaatcatctcaagaggaaatcatgtccagatcctagcatgtcactcaaagctctctgaaatctgggccctttctattctccaaatttattcccactgattccctttcatgaatgctctgctccaggaaaactaggtatctccctcccttgaatatttacacatgcccacacctgtaccctgtgtccatacatcagacatcctggacccaccacctaaaacaggcttgcacaggtgacaaaatttggcctcatcatctctcagccttgagacccagcacaggcatcaccagatttagtttcataggaagagcatgaaaaatcatatcattttttaattaagcaggccaaggtaagagatccatcagacaaagaagcaaagtaggaaggagagagatggcttctgtaatgggtttgcaaaggagagctctgtccctgaaatagcactaatataatccaagtaggagatttacaggctgcatgtttcttggtttccctttggagtgctccattcctaacaccagttgttaagcccctggtcctgaatgtggccgggggtgaggaagtgggaggagaccatgctggccactcagtggtggtgcccatggagtttcgggctcagactttctgtgagatacctcaaaattgagagaagctcaaaaggatcatgcagcaaaaatgggagaagtcaccttcttagtcataagaggattatttctgattagtccttgagctgtgttatgtcctggggaagggacagtaagagtagaaaagtctctcctaggacaaggataggaagtggtgaaaagtccttttcctggtgactagcaaagcaggggatgaaaagatctggagttggagtccagggtggattccagggcagacaactgcataggactgtctcgagttctgtggattgaaaaggttgggcatcccttcagatgttcctgagctgacctcagtcagaggtgcgtggctccagcacccagaaggtgtgaccagcacaccaacccctcctcccaggtgggccgtgacagcttccctcaatccctcccactctgacaacagtctctctgattgcttttgctttggtgctctggacataaactgttcctactttgtccaagtgaggtatataattttcagaacgctggagaattattatctaaaacaccagtggatacgctacaattttggcattcagtattctgggcttgtgcaggaaaactctttctttagaacatgtagaaagactatcctttagttatccagtgtggaaacagtcctgaaatccaaactgatactgcgatcctgtgccaggttattactgtgacaattacttaatattctctgtgctcacgatatcactccttccagaagatctttagggaaaacttagttcagtttctaggaggtttttgctcagccgaagatcactgtgtgaataataatgcaggcaacatgctcacctttggagggggaacaaggttaatggtcaaaccccgtgagtatctctgctgaatccataatgaatgctctaatttcaaaaggaagccgtagcactgagctctgttttctgttttctctacttaattttatcttttatattaattctaatggttacatgttatcgatacatggcatatgtatatatgaaaatggacatacatgtaactgtctggcgtgggaacaaatgtgctggagaaaaacagatttcttgtcctttttgtcttaaccatttgggtcagaaggtctgactgagtagaacatgggctgggtgagcactgcagtgggggaatccttctccagcagctttgtcagaattatgctctttgctggcctggtcagaaggcagctttgtcaggaggtggaaggatgaactagttaacctcagaagagcctttccactccgaccatgctgggaatagaccgccataataaacagtcttttccgctgcctctttagccaacgtcccagctggaggagcacgccggccagatttggggattgaaagggatttcctgatacacattggcctggtcggttttggtaaagctttctatgactgtgtaatgctggcaacaaccgtaagctgatttggggattgggaacaagcctggcagtaaatccgagtgagtcttcgtgttaactctgtcaaacctgtctgtgcagtttgaaatatctcagaaactgcctccttcttttttagccctgaggtttaagatatctagttatggctagtgttttcttcctgtccaccaaagctgaacccttgcctacccctcaatcaaaataactagatagagggatccatatgagcagggtaggaaggccattggagtgttcagctgttttcttagagagcaaatacattcgtgcattccaaaaaggcctgtgtgggagcactgaatattacagaaggtgagtgtgtagcacatttcatggccgctttagtctgcactatgccaacctcaccgtgggccattggtaaatactgttgctttctggccaaagacaggtcaagtgctgggaactctcgggactcacagtcacgctagtgaccgtgctagagcacatctccccactgtggattatccagaatgactcaaacttgcgatataactcctgcatctctcagttctctttggcttagagccttattgtggatttgctagaggtaacaggaaaggaactgatttcatcctaattctagcctcttctgagaagttattctctgcaagagtcttcaggagcatcttacagaccacctacactattcagaattttgttccgcacaccacattgtgttcccagcagtgtttgctgtggctttggctggggccaggtcctgagtcagttctggagctccaggcttggcaaagctggataagggcaaggggagttgtacagcagaaccaaagggcttcaggaaagacatctttgatatagacattaatgaatttctaaatgggcttctatatgctaacctgataagactctctggggagaaggtcatgctttcctttgcagctctaaatataagacacatgcagaaaaaaaaaaagaatgggaaatgtctgttacagtgccaaaatgaagataatcagtataaatattagatttgtcttaatattaagtttatgaaatgtaagtctttcagaagaactatctcaggatatatttattaggtcaatgaaatattttatccatgtgactggtatacacacttcaaaggagaacccaaaatggcaggcaggggagggtggctaatgaaaggtatggcatagtagttaagaatatgaattttggaataaaactgtttgggtaaatcctaattcagaaggttacttaatctctttatgcctcttttttctcatctgtaaaatggggatggtaatagtacctagctcactgagatgttacgagatttaaagagctaatacctataatggactttgcataatggcagcccgattgaaagttttcagttaatatgtttttattgctactatgtcaggttgctggagggaaggaagaaaaatggaaatgatccccatttatagtttttgtaaagtacagcattagagtgtggctctagcaacacaggcaaactaatctttgggcaagggacaactttacaagtaaaaccaggtaggtctggatgtttctaagtgaagtgcagttatccactctgttcgttttttgtttaatcttctctgtctcaacttctaaccaaaaactcttactcttaggttatattttccttttataaaagtaagtagaatgtgtgtaaagtctggttgatatgatcctttctaactcacttggtttcagctagtggcaaaaagaagggtgtattggatctggaattcttaggttaaggctgagagaatgtgagtttggctgacttggaagaaataaaaacatcaaatgtgggtggttcacacaaaagaaggtgatttttcataataatatactaaagtagaatccacccttgtgaccaccagaattattcaagtacagtcttccaaggacaaaatgggtagcatggaaatgatatgtttttttggggggaaaaaacatggggagagagagagaaaggggactattagttgtctggattgttaggaaacatggaagacagcacttcttgttgtaaggtttggcaaaggttatcaccaagtagaagtccaaatgtgtgtaacatacccctggcaaacgttatagaagaaggaagctggggccgggcacggtggctcacgcctgtaatcccagcactttgggaggccgaggcgggtggatcacgaggtcaggagttcgagaccatcctggctaacacagtgaaaccccgtctctactaaaaaaaaatacaaaaaattagccaggcgtggcgggcgcctgtagtcccaactactacagaggctgaggcaggagaatggcgtgaacctgggaggtggagtttgtgccactgctgagatcgcgccactgcactccagcgtgcgcgacagagtgagactccatctcaaaaaaagaagaaggaagctgggagcagtgtctctcacctgtaatctcagcattttggaaggctgaggcaggaggatcacttgaggccaggagttcaagaccaccctgggcaacacagtgagacccccatctctacaaaaaataaataaataaaatttttttaaaaatagccaggcatggtagcatgcacctgtcatcctagctactgaagaggttgaggcaggaggatcacttgtgcccaggaggtcaaggttacagtgagccaagaacacaccactgcactccagcctggacaacaaagtaagatcctgtctctaaaaatatatatttaaaaatataaaataaataagttaaagaaggaggaaggagatgaagaaaatttggcttagtaggaaagcgtttttgtactgggcagaaacactgtgtcaaactggggcaaacaacctcttctttgggactggaacgagactcaccgttattccctgtaagtccttacctcttgacaaaaaagctcttagtctgtaatgacaagttctcacatcccagacacctaatgaatttctaaatgagcttccatgtgttaaactgataaaactctctagggagaaggtcacccttacctttgcggctctaaatgtaagacatgttgtaagaaaaattgggaactgttaattgcagtgccaaaatgaagacagtgattacaaatattgggctagttttaatgttagatttataaaatataagcctttccaaagaaccatctcagggtgcatttattagtttgtgtctatacagcccaattgtccagttactttgattaatgttggtagctgatgcagatatttagggacttccttgagaaaacttctttgtgctcaaaattgcatgaattgaatggcacattacctaaataattgccaaatctgtttcactttgtgctgtatagactcagcctaataaaaacaaatgctgttgtgctttttcccagtctgtctcctctccacacagaaagtttccctttctactaaacagcatctcttcacacgaagaaaagatgcccagcaagccatttgacttattgctgctgctagtttgcatttatatgactcctttccttagaagggatgaagacactttatacgacttattagctaaacagattgacagcctaattaggaagagagaaacagattctgagtatctttttgtggctgctgttcctaccccctcgtgtagaacatttggtcagatggctctttgagacagaaataagacagggacgtggtctctgcttgtagtgtgggacgtctcagctgcacctaagaggttgtcacaggagtactaaataggtcagggcaactgacacagccaggaaaatttctttcccctagaacttgtgtgtgctcaccaagcaaagcgtgactaattttgacatccattgttagtgtgtgtctacccttcttgcctttgttttcagacccttcctctctagatccttttccttccatctccaactcctgtatgtaaatccctgctctctcctttgaattcctgactgctatgcccatgcccagcaccggcacccccacgcacactgctgcctgcctctgtaaccatcagctgtatttctgaggactttcctagctccttgagtgatcctcaaatggctcagggccctgagggaatctttgctgagggttggccccagcagagccgctgcagaggtagaggtggccaccaagggacacagactgcctgcatgaaggctggagctgggcccaggatgaggaaaagcctcaggaaggaggggctgacacgaaataaggaataccatggcattcatgagatgtgcgtctgaatcctctctcttgcctgagaagctttagcttccaccttgagacacaaaacatgtggttatgaagagatgacaaggtttttgtaaaagaatgagccattgtggataggctttgggaatgtgctgcattgcgggtccggcactcaagtgattgttttaccacgtaagtatatcttttctcatttctgtgggctgttatgtccgtaaatcatatagaacagttcttcttatgcacacacacacacacacacccattttccagtcactgaggagaaacagtctctgggtctacctacacagccagtttgaccattaagatggtcaaattcatttttcaagataattttaactggttccatttaatgctgccaacagccaagggcattagcatgtcgtgggaacctaatctatgttcactcactgctgtgggaggacagtcatttcttcttctcccctggcagtcagacttcagaatccagctgaccttttccatgcctgtctcttctggcagattaagtggttatttccactaactttcttgtggaaaaacacacaagacagatatattctccttcagtttttactaagaaagttttgtggttatcattttgacaataaacttcagctagcatagtccctactattcatgttaataatatcttgacttgaaccatcatattttccccacatcattcacaatgcatttcaatgctgtaacccactgcaccatccccagcccttttatcttcacaacgttctctaataaggtaaacaggatcatacatcatcaaacatatgtcacagacagaaaagctgacacacagacaagttaaataatttaagtcaaaccaaaaaaaaatcataactgggattagagcttgagattccctattttcttacagtgaactgtcttgagctgtcacttaatgcattgaaaacataataagcacaggccataggcattttcagaacatgaaacttgactgaaacaaaaactgactgtttgattgctttggtgttttaaatgtatccccaaatctcctttgctattgatagtcatttggtgccagtgacagggaagagcagaggggcttaggaggtttttgtagatctcagtatcactgtgtcttataacaccgacaagctcatctttgggactgggaccagattacaagtctttccaagtaagtactagaaaccaaggagccattttgaaaaggtgttttctttttctttttcttttttttttaaatgaagttttgctctttgttgcgcaggctggagtgcagtggcatgatctcggctcactacaacctccacctcccgggttcaagcgattctcctgtctcagcctcccgagtagctgggattacaggcacctaccaccacgcctggctaatttttgtatttttagtagaaacagtgtttcaccatgttggccaggctggtcttgaactcctgacctcaagtgatctgcctgcctcggcctgccaaagattacaggccactgcgcccagccttaaaaggtgttttctataaacaggaacgttctcacagcactgcaggccacccttaccaactccgagctctgtaggggcctttagcacctatagctgcagaaccttctataaaccaattaatctatatgtgaacaatttaacctatatgtgaacaccatggtactgagtaaaatcttaccagcagtgaaaagaaggcactagagcgtcagatgcattatgactctaaacaaatgatctgtttccctcttttgcatttttatttaaaatatcagggaaggtgaagcaagttcaacttctccaatttgaaaactgtttctgaattatgcttcccttgtatgcagagagacctagattgactttggatgtttagtcattcgatttaatcaaatgtaattaaatgagcaaataatctccaatagccaatattcctatgttgtttcattgttttatgtgctttgctctagactttttgtctgggctttgtctctaataggatccccggaaggacagtgaaggtttttgttaaggtttttgtgtctgtgtggatagcaactatcagttaatctggggcgctgggaccaagctaattataaagccaggtaagtctcagagatgtgactgcacgggagaggagacactagttgaataatgcacaaagtgtagcatgcagattatatttttaagaacaagtcagcctgctggagacaatgcactcaacccaaatggggtctccactcccagtgagaagcatgtcagccgctaactcttttgtttggtctagtagcttccggaatgaataatgcttaagtagccctctaagagagcagagccaggttgttagggaatatctaattccctctgatatggttaaaactctttgccaagggcagaaccagcctcattccattggaagagcaaattcagagaaaaaggaaagggtcacacagccaaagacggtaaaatgttcaaaggtgaaaaatagccaagtctgcagctctcctgacatccttgcctcaggctgctgtcccacgtggagagcagatgcctgcaaagctctcggtcacttgctggagtcactcagggttctgggccttgggatgtaacttaaatgacagtgtcagggcactgtcagaggaatatgaaggctgcagcgatgcctgcaagtcagcttttgctacactgggactgaggtgttctaagcctggaaagacacaaagctgtcctcatcccaacctgccgtgcccctccttgagggttagtgtaaggctctgaaggactgtgtgaattatggtggtgctacaaacaagctcatctttggaactggcactctgcttgctgtccagccaagtacgtaagtagtggcatgtgtcaggtggattctgtgtccatggcaagtaggaagcgacagccacccttaggtggaaaggatggctgaaggttgactttgttcactgctgtcatctcttatctgccgtgatatagcaggctgtcaaaattcccattctcctggatggcacaccacagtcaggggaggggaaacatgctaattttatgataaaccccaggggagaaaaagactactgtgggaaaatttagttgagaaaatcaaattgttctcaactaaatgctgcaggctttatgcttctgtgaacccagtttcccagttattcattgaccctgaacatacgtttacctgtgcaaatacaatctctcctaacctatttatacaattatgtgtctgccggtccaaatgccttcttctataggccatgtttttatttctcttccaaaagagactccagagccatccttgggaagagtgctgagaagtcaggcaggcctaactcccaggggtcagggaggggaaagagaaggctaagggtaacttagctcagtactagaactgtgatccacgtatctgtcactctatttcctacgtttgcttcccttttgttttctctagaataagttctttttgtttgctctggacacccactgctcccaggatgaaaggagagaaatgagatcagttttgaacacttcctcttgaaatataaagaatcaacaagttacagtcatgttggggacttcttctctctccaagcttaaatttctattacgtaagccttacttttaaccaagaaagttagtgacatggtatcactgtctgggatgctcacccctctctcttttctccagatactccgtgtatactaaagctcagccaatgctcagctttgtgataaaggagctgttgtgtgtctttatctctgcctttaggatacagtcttttttataacagaaagtgttcacttctcccatttatttcatggctggactctctaccccttcctggctgaaacagcatatgggtccatggtggaacttctttgggaaaaaaaaaaaatagaactgtttgacttttgccactcttccctcatgaaatgttttttaggctatcaaataagcattattacacattgagaaggctttgaaaaaacttgatcactgagtctggaggtgagctgggatggctctgtagctggaaaatatccctgtgggtgtaggaatgtaccgtcccttcaaacttgtgtgtttagggctgagctcacacatacgacagcaagagttgttaacaaattagattcagctttggcagttttatgcctagaaatgcaaaagaattttaaaagctcataagtttggcatttttaaaggagacattgtttgctttatgttgcagagccaatttttcttcctatcataaaaggccagaaacacagagaaagcaaaaaaaaaaaaggaaaaaaaaaaaaaacacaaggagagtctaactgccccctcaccacagtgctatgtgtttggtagggttttactatgggtttcagtaaaggcaggaagtgctgtgggaataacaatgccagactcatgtttggagatggaactcagctggtggtgaagcccagtaagtggccatgttttattgatatttgaccaaacaaataaatcccgtgaagttagtggagatttaatttaatatgtaaacaaatctacttcttgaaaaatgacttttgtgaatacatgaaacactcgtgattattgagactagagcaataatgataaataaaggcaaaatgagaccaccccaaatcacctttaacattgtggcttagccctctttcttctagagagatatggggccatgagctatttacagccgcagtatctcttaaactatgttctgcaatgacttgtgtgtttactctgattttagccacagaatttgttttccattctattaaaaatgagaatctatctcattttaaatgctactaatatttataaggtaccttctttgtctcttgtacctgcatatatattcatttcaaaaagatctcataagaaacccaaacattgtcgcattttgacaaatgtccacatctagtcccgtaatgtcaaatttcactaaaaacacagcctgactatgcaaatgcagtggaagaaaaaaacaattcagaaatggattgacactcccaggtggctttataaacacctaaaaggaaatccagagtgaaataaaatggcaggtatgataacacgatttttttttaatgatcaattcctccatggggaataaaagtttttaaacttacctccttgaaaaggagggaaataggagttcaggagcctggcattcccaggtgtgctcctggggtgtctgtttctccacattgccattttggagacaataggacccatccaaatgtccaaccaaaaaactaatattaagaggctggagtcaccacattgactgtctgttattaaaccctataacaggttataattaagattatggaatgactaacccaaggagctttaaaataggatagcctagttttaaacggttcagccttgggaaatgctggaagacaaggaaatgagatagatgactccataggtttgttttacgtctggtgaacatatccatcccatgttaattttttttaacgactatgataaagagcttctttggggtcaggtagaacccaaaggaggaagagaaaatgggacttggttctttaagtgtcaaacaaggatccagccagggttgagggcaatggcataaggcttccctctcttggtggtgagagaccacatccatggactgtggaaggagaacattttctaaaagacggggatcccttgggctaaaatgaatgatgctcatgacccccagctagggcagggctataatgagtacagcaaacataaggcaaggtatcctcagaatttggtgacagggcaaattctagaacttaaggcttagagccagggtgaagggaagactctgtaatgcagttccttctcaggtggaaatccagatatgtgccctaagtgacctattcctgccccatttttgtttgggctctgaaaagtggattcctagctcagtggctgtctgccaggtatcttttgccttcagtaacagaattatgtttgatattggaaaggagtttgttgtattgttggctttataattcactctcagtgtcaaatgaggtcattcaacttcctctcgcacatttgcaataagcagcatgaaattcaagcagaacaactagaagacacagagaaagatggctgagctgataatgaggcctgtttattacaggagaagagacaatataggaatctgttaagtcccatgaggttgaaatatccaccaaaaaatatgcagctgtcccccaaaaaaaagtcactaggagtttttgttatggtcccaatcacagtgtgaacagagatgacaagatcatctttggaaaagggacacgacttcatattctccccagtaagtgctgtttatgtgattttctgacattaactcccactgagttcaaactgctgagagtgttcagtaggaaagtttctaagacatgtgggtggcctgtaggtcctgggctcttctcttgcagaggtccagtcctcagcctttccacagctgagccaaataccaaattctcccctccagggctggaaaagttgctaccagtcctctgctacccaaatataaattatttttttattgtttattaagaagagtaaaagaatcgtgacactttgtccagaacctattttccagtcttttcccccaggcttgtccctggtaacctctgtttggactcattgttaagcccagcgtgatttttggctccaactaaattgattttggaaatgactccagcatacctatgacccctctccttccaccctccataaaagatttatttttctttatttggcctctgctgagattcctggctttgatgccccaggatctctcatttcccttgttccagggataagtgagagatgactttttaaagagctactttcatcttagagacaacaaagagagtatgccagcaagagcaacatcttgcattgagccttctcactctatgccattttccaaatctttttctttatttaggataagtgaccactcctttttatttctagtacagcaaagagtacatcatgatgtcagaaacagggatttcctttggaatgtttttcacaggctaacaataagctagaagtctgcaagcaattcagaaatgcatccctgagctacaactccatgtatggaagctcatcagcagggtagacaggcaaagcagaaacattttaattataccatactttgtagagattgggggagaagtgggcaaatgcgtgctaaggaaaaacaaaaactatggttaagtggggagatttctagatggttctaacagggaagaagaccaacaagaggaaacttccaggaaaaccaccaaggccaggcattcagggtttttgttatggaggaaatcactgtgggaattcaggaaacacacctcttgtctttggaaagggcacaagactttctgtgattgcaagtaagtgtttctagccatccttgattttgatcagcaatggcttcttcccttgaattatttttcagtgtacctagaatgcttttgcccccaagaaaggtttggaaggagctgggtcattagcattgcgcaggaaaattacaggttattctgttataattcgaaagccaactggacagtcatgaatgcacacagatctgggccctgcattgcaccctggcctagttgcctccagcttgttctgaccgtaatcctggcccagtttcctcctctgatcccaggagacaaaagccctgggcagagaaccagactacttagcctgggggaagcacaaaaaggcttgtctgagatccataagccttttttttttttctttttcttttttttttttttttttttttgagacagagtctcgctctgtcgcccaggctggagtgcagtggtgcgatctcggctcactgcaagctccgcctcccgggttcacaccattctcctgcctcagcctccctagtagctgggactacaggtgctcaccaccacgtccggctaattttttgtatttttttttagtagagacagggtttcaccgcgttggccaggatgatctcgatctcccgacctcgtgatccacccgcctcagcctcccaaagtgctgggattacaggcgtgagccaccgtgcccagccccaaaagccatttttaaatacattgcaggtttctatttaatgttgttattcattttgatttgcccaagtaatacattaaaatttctcattgtaaaccattcaaattacagataaagtccaggcacggtggctcacacctgtaatcccagcactttagaaggctgaggtgggcaaatcacctgaggtcaggagtttgagaccagtctggccaacatgatgaaatcccatctctactaaaaatacgaaaagtagtcaatcgtggtggcaggcacctataatcccagctactcaggaggctgaggcaggataatcacttgaacccgggaggttgaggttgccatgagccgagatcgtgccactgcactccagcctgggtgacagagtgagactccatctcaaaaaaaaaaaaaaaattacagataaaaccagcattcaccttggccacttccttcagtatcagtttcctcctccccaaaagtgaccactgaaaccagcttggtgtgttgtgatgagtttctctgtggaatatgtttatgtgaaatcccatcttcaaccaggaaagcttgagagggaaagggctcagactgcagtttgcaggatttcaattagatataaggaacagttgattagatgtaagagctgttagcaaaggaaaaccttataaaaactaggagctcttaataactagacaggtctttggtcagacaacacactgactgaggacaggaggatggattcgatgacctctgaaagtccagccaggactctggaggactctgaggaatggtctgttccatagcctgcctctgtaatgcccttctctcttgcctattgtctggttgttgttacagtctgagcttttgtcagagctgctcctatgctgtgagtggtctgattttctcagcatctctggggtttttgcaaagcaaggaaactctgtgcatactctggggctgggagttaccaactcactttcgggaaggggaccaaactctcggtcataccaagtaagttcttctttctggctaattattcttcccgagaagcctgtcttccatcatgcagaagctgtcaaaacacaggtggtgttttctttgcttggtttgtgttgggtggttagtaatatcagttggaaaacaaggttattaatgcacatattccctggggcattgtattcggacatttaatatccatgtagtctctccctgtgaaaatatgtgaacctccacgaaaagaaaggtccaaggaaagtagcagggaaaaggcaggaattggatgaaaatagccaaagagcctgcaggaatataaacaaggcaggatcccaggagacagagcagtagccactttgagtgaatttcccaggaggtgctcctgccaaggcccataccttcaaggaaaattaaggcaaatagaattgggctggggagttgctacttattagtattcctcccacgttctaacctaattataaggaggttgttttggccatgggcagtcatctcaggttttgttttcctgctttcctccctaacctccacctgtcttcctagaggcctgagtcaaggttattgcaatagcactaaagactgtgtaacaccaatgcaggcaaatcaacctttggggatgggactacgctcactgtgaagccaagtaagttgtgttcttctttgcctaggccttcaggggcaatcaatcaaaccattagtttgaaaaagactttaatcctatgcatctggttgggctctttattaatgttctttccccaggccaaagagagttggttctcttccctgctttaaaatgagatatgagtgcatgtatgcacacacgcatgcccacatgcagactcttgctctagctcatggtaagggcttctcaggagcatatacaacattttgaaagaaatagagaaacaaacaataatgagccaatggagctgtcaggaaggttctccaccacccctgaccaggcttcccagcaggatctctggccatataggatgtgcttgcactatatcggatggtctaggatgggaaatatctctctgtaattaattccaaaatttggcaacccttattgccagaaagtacttctcatatctaagtttgatctccctgctgcgatttaaatatctacttgaaaagaaccactagaactctgtacatctggattgagaatcaagtaactgccatagaatatgaggctgagcactaagcccacctctgcagcacctctgacgtgtcatgggtcccctctggacattttgagctcaagtaataatggattaagcaggatagcacaagctttggaaacagaaaaacctgaattcaagtccttgctccactacttacctagctgtgtgaccttgaacaagttacttaatctctctgagcctcagtttccccatccacaaaatgaagataaaaatattcctacctcgttgagtcatcgtaaagatgaaataatacagctaaagtagttagcatagtgctcagaacatagaaaaagctcattaaaccctcgctattaataataatgataaacatcatctctaacccacagcagagcctttgtttggcccctggggctcttctgtcaaggttctgttgtgcatcagcagcagagctggaattggggggagggtggagaatgtcagcctgttctatgaaattcttcacctgggatttgaaagtggaaatacaaagaatcctgactaatttaaatacaaaatcatccaagtgtcagaggcaggggagaggtttctgcagagagctgcatagctgggatcctcaaggctacacacacacgcttggagcagggatgcggttcacaggatggcagggcaaaggttgcagaactgaaaccttgtacttccccatcaccaaaatgaccccagcatgatttcctttaaggtgtcccgagccccttcccaaaagacaggctccccatgtggaggggcaatgacagagggaagatggaaactttatgggaagggcgatctatcccaaggttgtccttctcctcttcagggtagtgaagctcatgagaaatatggctcctgaaaatagccactaaatgaaactctccaacctggaggtagaggatcagtaaagtctgcagaggcaaaatgaggcagtttatttcaaagaaaagaggttgagggcaaggtgggagttaagtcacacatctaaatctgggaaaggaagcattaaacagaagacggaggggctcggctctccacctccaccaggattcagaccacaggacatggctaatactgcaagaagggagttaggttagtggtaaaacctttctaataggtttttgaacagtgaaaatgagctgtcaggagtagttgccagggcactttctctagagagtttttgaaaggagatagacaccctgctatcagaggtgattggagtgcagccctgcctcgaggcaggaggagaaatgagagaacctcttaaagcctctttccagcccccagagcctgtctccatgaaaaaggcccaggctcattaatgcagagctgcatcctccaggacacagggggttgctgggttgttaagtttggaacctttgccggcttagtggttaccaaactccctttgttctcaagacttgacttgataaatgggctggctttatccctttaaagccaaaaacacaggttctgagtgctgtgttgtttgtggtgttgagatgcccaggctggagggaggaagctctagggggtttttgctgagcccagaaacactgtggggataactatggtcagaattttgtctttggtcccggaaccagattgtccgtgctgccctgtaagtacagttaagtggagatagaaaatgagtccagtgcttgatgtggggagaagctgcagggtcttgaggccaggagtccaccgtgacctcaggagtggtgatggagaagaaggttaaaaaaggaatgagaaacagaaccataaggacaatacagaggaagggttcattttcgggaaggaaaatcacaaggccgtgtgattaacgctggaggaaatgcactcctttggagggtcccttctcaggagggctttgtgtcggggaaagctgagctgttaggtttttgatgctgagataatcactatgcagaaggacaaggcttctcctttatctttgggaaggggacaaggctgcttgtcaagccaagtaagtgacatataatttatatgtgctgaatatgattatctccaagaggaaaacttgccctcttttccacgggtgcctccttgggtcaggaggacattaaaggtgttgagcagaccaaggcccagtacctcgtcaccttcttcatccttgaaggagctttaagaggtgtggaggggaagaaacccaccaggaccccaccaataagcccagccttgagacccctccactctgtcagacttgaataagaaccatctgagaacaaggtcttcctcagaaggggactccagcatagtcatccccatttgatagattttgaaactcagggcggggcagagtggctcatgcctgtaatcccagcactttgggaagctgaggcaggtggatcacttgaaggtcaggagttcgagacctgcctggccaacatggtgaaagcccgtctctactaaaaataaaaaaaattagctgggtgtggtggcacgcacctgtaatcccagctactcagaaggctgaggcaggagaatcgcttgaacccgggaggcggaggttgcagtgagccaagatcatgccattgcactccagcctgggcaacaaaagcgaaacttcatctcaaacaaacaaacaagctcaggcaagtagaggccagtgattaacactcttccaataggaacagatcccaagcaacctgcagtagtttttccagtaggctcgtgaactcaaaacaccaagttatttaaatgacagggcaaccgttgtgatcagctgtcatttgagtagtgctgaggactgggtctgaccttgagtaaacgcctaggctggtgggtttctatccctgcagcatctaaagcggacgcccaggcttcactgaccccagcagtctggctttctgcccttgccgcccaggaggtgcagctcttggcacacaccatccttagtgtcttgaaagaagagaaattaaaagagaaagggggaaaagcttatatctcatatcatgcagttgcctcattttgtagcaagattgtttccccatgagcagtttgtcttcattcagcagctgtcttctctggggaagccattttgtagaggtgtttgtcacagtgtgacaactgacagctgggggaaattccagtttggagcagggacccaggttgtggtcaccccaggtaagccccattccctggagcctcacctgcccttagtatttggcatgccctgcatgccaaatatttctagccgagactatgagaaacacatctgaaaggaagccatttccctgaacagcagtacccaaagccattaagcaaaaatgagagatcagactggtgttaaatagaaacgtttttggataaatagtaattctcattattctctatcagtctcctgtgtgaatacccttatttcccttataaggaaaaaagttacaataagcaggatagccatgattcatgctgtggtgtgggagcaatctgctgtggatttgggggtggaggattagaaatgtgttcaggcagactggatgtgtttttgacaggatatgtaacacagtgtgatttataaccagggaggaaagcttatcttcggacagggaacggagttatctgtgaaacccagtaagtataaaattgtatccctggattaagcaatgtctgtggattaagggctgatttagacccaattatacaccatatgaagaatgtttagagagggggatgagcatcaaataggaagccaatcgtcgtcctggctaggatctagcatctcagtgcaaaatgggctatgtaagtgtgcctctgggaattgctcctgaatatatgtgttgggactaaaatgtatgactggctacttgttgtattggctgggatcatatccctggatttgtgcagtaattggtgacaagatttctaattccttaacaaaccttctaaggcactattctatttggctaagattatgtcaatttatagaaggaaagaaccttgtaaataatgatcattaaccaaaagtaatgtgattagtctctctcaaagtctgaaaaaccacttttttttaaaaagtttactcatgactactgagggacacttcctgtttctgagactttcagccaaaaattcgtacagcgtagcctcacggagcagagagaaccttgacaacattcctttttgactttctccatggatgagaaaactgaggctcagggaagagacagatcccggccccacagccagtctatggctgagctagaactagattttaggtctctaatttgccaaacctgtcagttggctcaaacttgaagtttgaagagtccgcaagattcatctgacaaatattttcatgtacttgccctctgccaggctcgttgctgaaaccagggatccaacaggaagcaaactcagtgtgatattgccttcatgaaacttacattctggaggtggattccatgtttcttcccagatatgacaatgcttaccctgatttctcttgggcatggctctcttatactatcatcacttccttaggaaatactaaaactaatttttgctgcagtttaaagtccttgagcagataactaacacacataccactttagtcaggagaagggaaatgcccaaaagtgaagtagaaaactaggaatttgtctgataattgattattataaagttattttatcagtgtgaaatgagtggccaaattaactggacaatgccagctctgtacctacctcactttgattctatagactcagtctcaggaggattcaagaattcagacagttctctgatgacataatccagtgatgcccacaacagaggaggcgtattctctattctggactttgtgagtctccttggatgaaaagattcaagtgctgttttgacacctaaaatcagagagtatttgctctatacatatatcgaaaatacacagttaatgtttagaactttgtagtggaaagtggaaagcaaaggtcccctaaaagaaaatgggattgtaaagacgaaggagggttagtttaggatttgtagaaagtcagtttggctactccagaccaaacctagattaacagtgatgcaggcctaattcataaaggaagcactgccagctctttattcagtgctttgccaacctggcctgtttgatctggtttttgttgttgagcaaatcatagtgtttcttctggttctgcaaggcaactgacctttggatctgggacacaattgactgttttacctggtaggctgcctcaattaaatactatttgcactgatttactaatctacaaatgtattctgtacatgtaacttaatgggcctgaggttgaagatggggagagacagcaacaatgcatactagaaagggtaatgcgagcagagaattatttatcagagaccaagaagagaaagagaagctttttgctaaggcttttagtaataggagttaatgaaaatgaatagaaaaaaatttcattttaacttagaagaattgctgaataatgggaacagattccataaggggaacctctgcttctgaaaatatttgcactaggaccagcctacgtgctacaaaaactgtctcacaccaagtctagttggtcacttacatttttagcctattctagtagctatttctaaataagtctttaaacatagaggtgcctatatttaagatatttaaatgaggctctatttctatagctctctggtgcccttccagcaaagcattgctgtaacacattgcttatcatttctacaagtgagaacaagtaagcccctggccctccaaaattgcatgagtattataattacttggcttagattgaagtcacttctgtgttacttctcataactgtgttcatttgttgagatctgtttaactccaaactgtgtgggcgtctaactgttggcactaaggtttcttttctcttgaaattgccagcaaaatattttacccataaataatgtttcatctagacttgcaaatgacaactaacactgcaggctctttttttttcttttgctttgtttctttttttctgaagggaatatgcaagcaggaagcaaaaaaaaaaaaaaagccaaaatgtacagtttgactgtggggtctgggaggagagtgtcaatgtggatgctaaaatatacatggttgtataatgtaggtactgtcacagagaggctatagtgatcttattagatcatacatacagagcaccactggtcagctggcgttgctcggggtgtccttaagaaaagctcaggtctagttgtcaagtgcaacccagattcagatacagagtctcagagagaagcttccagatcaccctggagctaaatgcagaatatgaattttccccttagttaagtctacctgaggggaattttcatttataattaggaaaagagaaaggtaaagaacatttacttgcagtgtcctgtttcaaatattgtgtgcattgagcacagaggacacaagaatgaacccaagcagaaaactaaagaaaagaaatcaataaaaccactgaagaaaaccagttgcccttatcttgcctgtctctgataatgaatgtgccttccctgctcattcctcactttggttctcaaattttccagggaattagcaaagaactggtagggttgggttagtcttggtctaatttggttagtcatctctggataacaagtctcctttttaggaagtgccaggggattttttgtaatgccaataaacatggtgtacaacttcaacaaattttactttggatctgggaccaaactcaatgtaaaaccaagtaagttatagttgcctagaagaaaaagttaccaacacattatgctaaattcttcttttcagtctgtatttcagttcttttattttgcattttgggtccccacccatgatattttattagtccttattcatatgtcacttgaacagatatgtagtaaacaaatctcatgatcgagtagacatgctgaaactgccaatgttctcaaggtgctattctttataaggaaaatgcccaaattttaactgttgctactgaacaaaagagcatttggatataatttaaagcacccctgaatgtccaggatttcagagaggagacatgacaaattaaaattatatgtattatttaaagatgaaaagaattagatcctcttgaaaatactctaataactaacatttcttcaacattcgcaatatgcaaagcacctttcataccttgactcatctgaccctcctaacaaccctctgggatagatattacctatctccgcttccacagatgaggaaacagtgtgaaaggtaaaactaaagcaaagaggttgaaatagttacccaagggctcaccgcagatgaggggcagagctagattaagagcctggcctgcctgtcccctagcccactctcttaaccatggtcttggtgaggtttgtgtagggcgacctcgcactgtggttctaacgactacaagctcagctttggagccggaaccacagtaactgtaagagcaagtaagtaagaaagaaaagtccagaataattttaagcaaaatggtgggtaggtttttcagcaatttcacctaggaagtgcaatgtcaagaactaaattctaagagctttcccagtttgtgttagaaccataatttttctacctcacacgtctccctcgccttctctgtcacctcagaacagctcctcctaaggcatgacttcacaatggtacatttgttggtggcgcagtctttgtggtcagataaaaactgagctaattatctgaaattatctcaggtctctaagtgagagagttaactcctttcaaatatttgaagaactacgatgtagaccaggtaaggggtgagtgtggaggccaaatcaaaacgagcaggtgcaagatgtgccccaacctcccctcaaacattgttgaacaagtggaactgccctgcagtggaaaggctgctttgtgaagtatggaacttttcttccttagatatcttcatgccagacccctaaggttaaccatgagatgttgcagaaggcacttctatgccattttagctattagattgaatcacctctgggctccctttcaaatctaaatgctaagatcccatgactcaagcctggaggattaataggtgagctcagacttgtttcttctatttttactattttgatagccaaagaaataattcatcaaattattcataagctaaagcctacttgggatttttacacctagaagatggtggggtatgatttcccagtgcagtaaatgagaaaacaataggagacatcaaggaggaaaaaaagaaggaagagataaagggaatgtcttaagggaggctcagaggttgaatgaaggaaatgaggtgattttgcagaggacagatgtggctatcaaagattttacaatttcacctttggaaagggatccaaacataatgtcactccaagtaagtgagcagccttttgtactcgaaaatagggccaggggagcaaagtttcttccaatttaaacacactcaaaaggatgtgtaattgctttctgatgggagggaactctgaaggtagaaagactattgttaccacagatcacttgtccctggagatatagcatctgaggactgactgtctagcttagactgctgtctgcacaagaagaagacttacagatgcttaaggaggatggaggcaaattttcaaccctgtactccaaagctgaggggagaggggatgggaaacattagggctgggttcatgtaaaggggaccagcattgtgccgacagaggctcaaccctggggaggctatactttggaagaggaactcagttgactgtctggcctggtgagtgagtcgctttctattccaggaaaatattactgtggagaaattaaaaggggagatgaattaactcctttagtcttgaaactaaagagatatgtgtacttcccctcctggaggaccccagtccctaggtagattaggacgaggaagcagagggagacaaaggcgatggaaagtcccttttaggaacccaggaatcagagagaacttgatggtccccaccaaaggcaaagaagggaggtcccactaaaacatgtgagcatcctaaaacacctgctctggtccacccacaatatttggtgaaggacatggccctccacccagaatgggcaagcaaactagaccagctttctaaggtgtgtttttcttgggtcctgtgactcttggccgtctccctgtcagaggctccatctgtcgctgcactctttcttattgagaatggcctctccgtggttctctgtaaactttccccaagaagcctgtttccatgcttcctcagcacttagcctcaccgatggatgggctctagagtagctggagggagtctgggtctgaaactttcactgagaaagtaaagttgatccgcagtatccagtggatatggcagctgggaggacctaggactgaagtactcgtcctctctttggggcctttcctgggcactcgattgaatacagaaaccctgttagcaagtgcatgcatgtatatgagtgtgttcattcagcatttccattctgaatgtatgaatagccttactctgaagactccctggagcttacagggctttctgttttcagagaaaattgcctttgtgagacaaaaatggccaagtgggcccctgaatgaggttatggttgagagctattaatattatccttattcacagagcaagatccgaattcccaaagcagagtagacaataactatgtgaagggcttagacccaaatatgtgcccacttgcaagcattccagctctatgaagaggatacagtgctaggagataggattaccctgcacattgcaaaccctccacttttccaagaccatagaaaatgtcctttgttgagcaccaactgagtgttattttcttggtccctgtggtttttgctgggccttaaatcattgtgtgatcaaagctgcaggcaacaagctaacttttggaggaggaaccagggtgctagttaaaccaagtgagtactggggcttgacccacaattgagccttgtcatcaatttgcaattcaatgtgccgtattggcccaaattaatgtctcaaacttgtctttaaaatgtttcatgttgctcttatgcataaacatgcacttatgtacaaattcagcatggataaaggatattgtcatcttgacattttctagaatctattttcttaagagaaggcacatagtaaaaggtacttttcttatttcttcacatttcttaactgattttcccaagaggcagaggaacttggacgtggcgtttctgtctattcagagtagttgatttgaatatggttacaatagcagagcaaggacttacaatttctaaggttcaaaatattgctgtctgtaccagcctgcagcctctataaccattattctgatttatttcctctggccctcatttttcccaattaatgtaactgaaatattggtaaccattatcttccggttcacagaaagtgtgtgaggattaaaaagtcgctgctctgaaaaggaattgagctggagggttttcttttgggggattattgttttgttgatggtattgtctctttcattgagggagagaataagaaaggaggcatacttgaaaggcaaggtaatatgatcaatacatgaacgtgtgcaaaataaatcattaaggcattcaactagaagccaaaaaacagtatggaccccggctcagccactcactcactaggcagccatgagaagatcaccaagctctcccagcctcagttaacctaaaatgtggagattattattccagccttgactacttcaaaggatgctatgaaattcagatgagataatatatgtgaaatctccttgaaaaagatgggtggtcaaatgattcatgatttttttttttttttttttttttttttgagacggagtctcgctctgtcgcccaggctggagtgcagtggcgggatctcggctcactgcaagctccgcctcccgggttcacgccattctcctgcctcagcctcccaagtagctgggaccacaggcgcccgccactacgcccggctaattttttgtatttttagtagagacgaggtttcaccgttttagccgggatggtctcgatctcctgacctcgtgatccgcccgcctcggcctcccaaagtgctgggattacaggcgtgagccaccgcgcccggcctcatgatttttaatagttagattttatgcaaaatttcatttgagggtaaacttaaaggtgaacaagtttaatggactttggccatggcagagaaatggttaggtttggatataaggtggacctctctaattataagaaaaaaaaggaacatgagaattggtgaacaagaccttccctggagatcttcagaaacctgaggtcactcaggagagaaatgtgtgaagttgagagcttacagtaaatggtctctgaagtttcccaccattccaaagagtgcgtgagcttaaaatttttcgtgagtttagctaaatatgtgcttagtgttagattaggtttcaaccaagcaaaagaaccctgggagaagtactctgcttggaaatgaagcatcctttggtttttgtggtacaatagatcactgtgggttttcagatggccagaagctgctctttgcaagggggaccatgttaaaggtggatcttagtaagtattattactaatgaattcttaattgattagtttttgagacaagtaataagcttttttggaaatctaagtggactgccaaatgttctcgatttatccatattgcatggggagcagagcattcttcatgccttctccatcctcacttctgccaggtagcagtttgcattgttaacagggaagcagaatggaagcttaacagagaagcagtatggaagacgtctccttagcccagtggtcagttgcatcagagaagtctgctctgaaatgcgaacactttctcttgcagctggcagccccctgcaacctcagtgccctccatggccagggccaaagcttccaggtgcccagataacatcccaaagtcactctgagagaagagagaaaatcggtcttactttaccttttctaaccaggaatttacatggttagttttacatctaacacttcagcagggagaagacatgatctaagtgtccatgtggacactctgtgtgactcggatccaggatctgctctttcagcccctccatttatcgcaaaagggatgatgattaattcctccatgcctagacttcactttagacatcacctcagagaggcctgtcttacccagccaatctaacaagccatcaaacacagccactgcctggctgctctctaccctgttatttagcctgattttaattcacacactttcatcacttaacattatactatctgtgtatttattgtttgccttcttctagaccgtagacaccaggaggacggggacagtgtctaagtggctctcaccgtatccctagtgccggcacaatgtctttacacatcggaggtgttcagtgaacagttactgagtgaataaaggacttagcaccaactgccgctctttttcatgaaattacagagctttgctatttcatacccaaatactaaaacctactgagatttttgcaaatttccatcatttatagttatatccaaggtggatttgagtgagcaggtacatgaggtatttgcagggcctcatttcactgtgccaaccaggcaggaactgctctgatctttgggaagggaaccaccttatcagtgagttccagtaagtacctgataattattgatcatagtgcttgtacttatcctgtagtcatatattgcacaggtgaccaaatgcctcctatttctttgagttaaggaatattgacatttgatgaggaaagccatttaaacacatgggaaaattggatgttgtctctcacccctaatactccaaccatagcccctgtcctattccatgctcttaaaaaaattttaattgatagaagaaagaaagattatctacaaggatatgagcaatttgctaaacagtggtaaaacgagattatgtacaggtgttgattcctaggtaaaaatgggggtcagagctgctatcctttggctagtaaaacaagattacttggtgaaattatgtaaatctcctcgaaagaaataagtttcagagttgtctagagaatatcacttggactgttctcaggctttccactacatctattgtaccactatggtgccctgaaaagaggctttctcaggcttaattccatggcttagtctttattccagtatcaaaaagggggaatcccagccagagctcccatgagggaggatagctgcatgctaaccacattaatctattatcaaggtaactcggtcatttttgtcaggcagcacagtgctgtgatttatagcacattcatctttgggagtgggacaagattatcagtaaaacctggtaagtaggcaatatgtcactaaagtaggaggcttaatgtggctactgagacccactaaacttactgcagtatttggaaggcccaagtgtcaagaaattaatggtttatgcagacttaagtggattccaatgaaggaagaaatgttaaagtaatggcacagaggatagaagagctagctgtgaaaaaaaatagccatgtggatgaaccaaacgcaacagactgaaagagcctagagagttgatcctaaagaaaaaggcagaaagtctggctgagcacttccagttctgctgacctggcttgattagtgaatctgggccacagtatctttatctataaaatgaaaacatttaatatcacctcagattttttgttttaattttgtgggtacataataggtgtatatatttattttaaagataagctaatatatgtgaaagtattttgtaaattcttaaatgctatccacatgtaaaatattatttgtttatagaacaaaaaaaaactatgtcagatttagaattcttttaacatgagaatttgtaggttcttagtgaaatagccatttacatgtgatctgtagccctaggcattggtaaaaagcactttctcttctactgaaatatagtggctcaaatgctacccaaatgaaaagggcaggggaagggaagtcattttgtaaaggcaggcattacagtgtgaattctgggggttaccagaaagttacctttggaactggaacaaagctccaagtcatcccaagtgagtccaatttcctatgctttcctcttccttgtgttgtcttctctcagaccgtaacatttggagcacataaagagatattatgggcctgctcttttctggctgtttcaggagactgaaaaggattgtataagaacatcctttagcatgttcttagtattgttttgtccagtgtgtgtttcttcttaatatcaaaaaaaactaagacattgcctgtgaagccaatggaaaacagtagatttgcaaagaaaagaactaaagagaagacaagtggtactttttaccaagcttaaagcagagtgggtgtcctttaatcagagggatgcttggttctgggggctggataggactcaggtaagtaacaaggctaccactgagtcactgagcttctaaaatgagttgactcgggggagcaggaagctgccactcatgatgatctgaatgctattccgtgaagtttcagattgattgaagttaaaattaggggtgacactatgtcaggaatctaaaaattgataactgtaatggaaatgaaagaagggctagctacatctgttggataaatggagttgaaaatcatgaatttgatggcgacagacccagagagttgggcaggtagaaacttcatttcaagtgatatgcagtaaataccccaaatttgagtcaaatggcctgtgtaaaaaggaagtgaaaatgtaacccgtatctccttgtaggtgaaaaggccatatctctaggtcttaggtatgaaaaggatgtgtgggcttctgggtgtttttgactgactaagaaacactgtgggatggatagcagctataaattgatcttcgggagtgggaccagactgctggtcaggcctggtaagtaaggtgtcagagaggcaacagaaagattgagggtaaaatgtcttcatgtctcaggaaatgattgtataatgcaaaatgagctggagttttttaggagcactgttactagagttctgatgtctggttctagcaaaagaaccctaatatagctgtaatccctctctagaaggaacaaggaagaggattcttctctgaaagctcctcctaagatttatccatcctctgccaaagtgtcttgtggatccaggatacttacatctttgttagcagtgctggcccaacctgctcagcctcagatcacctatccctcatttgtaaaatgaggataatatttaagctcatggcacagttgaagcccaaatgaggtagtggaatatatgcagattattaatccatttggctcataaatgaaggttttctttccttttccctaagtagatcatgggttgaaatacctaacactgcaaatcatttttgtatggggatttgctatagtgtgaattcaggatacagcaccctcacctttgggaaggggactatgcttctagtctctccaggtacatgttgaccccatcccacccatgttttccccctatctggtttaaggcttccatatgtattgcgtgttatcctcatggatttcatcatccttgttttattatcaatgttctgtgaatttaagattgagcctccatggactcttcatttaaaaatgaaaatagctaatagaagagttggaaataacagtagaactaattcactaggtcaggatggagaagggagtaataccctagacaattaggacaaacgtggtttttccagaaatagactcacttcctgtttaaagcctagactgtggtctctccccgggcacccttcacattcctctaaccctccatatcccaaatttagctgtggaatcttagacaatctgtgacctatgcagctacagaaatcttttcttactgagaatatctgcctatttgaaccaaaagatccttgagaatagacagtctctaatattccatgaagtgtctgatatggtccttttacaaaagtaaatacttgataaattcttgcttaattgaagttaaacacccaaagaaatcaggtttccaggccaaagggaagaagaaaattaagcaaatgacacagtacatttgagcgtgtagtggggaggaagaaatgctagattgggattcaaatagagccatgttttggtctctgctgccaactagcaatgtaacttagaccagatctcttgcctctaagcctcagtttctttatctgtaaatggggaagtgggtccaatggcctctctggcctcttagtacaaaaagtctatgaatgtatcccatttggggcacttttttctcctaggagtaactcaatagctattttaaagcttgagtgttttctaactcattagagcacatcaagaagaggggtgaagtgacaaaagggagtttattgtgaggcatcaaacactgtgatactcacgggaggaggaaacaaactcacctttgggacaggcactcagctaaaagtggaactcagtaagtatgagattctatggtaattacaaaatgtattctggtgacaataagtggaagaaaaggtgatgtaatttttgtcattgtatcttatttttaatctattactgaagcattaagaattgtgacatccagataaattagtgaaagtattcaaaggctatataagcatgctttcgttagggtggaatttagctaaccactaagactttttccaagatatgagattttcagctctcttcaacgtgagagtttttaatactagtattaagctaaacgatgctcaatggaagaaaagagctagaagagcagaaaattgcaccgtcatgatcaaatagatcctttctacttccactgccatggactcagtggtgcatttagaagagggtattcaaggtcattttagccatgccccaaaaaaaccactcccaattcattccagagattgtgcccccttatgctaaacatcatccaagaagagtcagtgaagtacagagaaaggaacccagggcttcttgtttcggtccagagttctaggtttgatttggtcccaactggatgtgtgatattggaacgagtcattgcccctctctgcacctcagactcctccagtggatgagggggtcaaagccctcaaaatctgttgttctgggatttcgctattataccacccgagagtttataggactcgagagtatggaatcttgtgagtatttcataaacaaattctatgaccctcaggaaatagccctgttaatcaacaacctaacttaacatagaaataataaccaccatctcagtccctaccatgtttagatacgatgctagatgcatgacatgtagaattgttcatctgaaataactctgtgaggtaaggggaagtatcttattttacaaaagaagaaactgaggctcagagaaggaagtgcccaagatcccaaagctagtaagtaaagggcctaaatttaaacttgggtctgcctgcctgactaaaaagccctgctctttcttttattttattttattttatttatttatttatttatttctgagacagagtcttgctctgtcacccaggctggagtgcagtgcagtctcagctcactgcagcctctgcctcccaggttcaagcgattcgattctcctgcctcagcctcccaagtagctggggttacaggcatgcgccaccacacctgaaagccctgctctttctactgcatgatgtcgtagagcttgtgctctagtttacttagaaatgagaggtgatgccaatcacagtgactggtgaaatgcttggaatttatcttttctactttagatattgctgtgagttagagagggtgcttcgggaaatcttgacatggatgccccaagtgtctaaagagttctcctcccctttcaatgacaaaacaaagtacagagttgctgggagcatttaccccaatagggagaaaagagaggggagctggctgcagccactcccttgttctgactgtccctttccttcgctgtttcttgtattttccccaggcagaccagccaccaatataactgatctacaagagcctgactcctttgtgagttatagagaaatgcagggtgaaggcactttgcacatagaactttagctctgagagacagcctcaaaatatctagttcacccctctttattttcccaataaggaaattaagacccagagaggttggctgaattgtctaaggtcagtgcgaactagggctgggactagaacctggagatcctggtcctggggccatattctgtgactgctgtttggtgaactaaacttctgataggtaggaagtgtgagttatgctcataaacaggaaaaacaaataggttttacaaggggagtataaaaatgtcctccttattactagcaccttagtataggctccctagacctgctccccagctgtggtgtaaaaatggaaggagaaggaaatggcccattttgtcgcagtgcaaatcactgtgggaaatactggaggcttcaaaactatctttggagcaggaacaagactatttgttaaagcaagtaagttccatgaaataacctgatttatattacagttgaagaacatctgttttcattgatttttttctttttagggggaaggggacatagttttgtctgccagttaaattagaagatacattggcaataataatgttgcactgtacagtatccatgggcatcactcttgcaagaaacatgtataataacaaacagttaagtgtggatggataaaacttccctaggtcctatctagaactgaaactctgtaattatattaataacttttttaacttgaatattagtgacatttttatataacccaaggtatacaaagcagaatcttcagttgggttctatctgatttgttgtcatcttccaatggtcttaggaaaattaaggttaaatagtaagattagatgcctcctaccactttggtacatgcatgcagacatagaaacacccttagtaactaacttgcatgtgacttggcaatcctaggctatggcccagtgacagggtcccattttgtacagagttatgtcagagtgtgaacacaggctttcagaaacttgtatttggaactggcacctgacttctggtcagtccaagtaagtcaaatctgcagaaatgtgtagccctatcctcaatattgggcatatatggatataattattctggtctataatagattattattactactattttgttcttattaatcataacaatgctgctaatttcaaatatacattttctgccatattattatttttacctttaaggagaattattgtcaagatatcaggagggaaatatttgaatttcctttgagtcaagtttcttatttgttcgtcagttcccacctctctgctgagggtcatatgaacctcacgatgttttggtttttataccgccttcttattatctctcttagaaatgcttccttggtttttccttgcctaagcacttagattttgcagctcacatttacccagagtatacttagcttttaacctctcccaaaactggcctccctgtcccaataattatgcacagtaaaagtcagttcaattcagtaaatgattattgagtatcatcaacaaaccagggaatcatcattggttttaaaagaaagaaacaaagaaaagaatttttaaaaccctaagctatcttaggcttctgatctcaagaacttccagtcttatcagagaaactaagcactcataataaaaagtctaacaacaatttatatgtgtatgtgccaagataggggggtgggtttcctgagggctggagacaggacaggtatgaccatgcacagccgcattctttggcagagaacacacatgattcccccaaatatgtttctggaaacggaattgagtctgttctgtgctgagatctttgactttcttgaggacaaaagcccccttggcagttagcatccttgagcgggggtgaggacagaaacaggaatgagtcaggcgtgagtcacccaagactctcactcagccccaagaggatggagtgactctgagtcatgccgaggcatgtctttagcatgtgctccagcacagtgtgcatttatggcaaggtgaaaaatacatttttgcacatgtcactaggaaaatggtaccttcttctcaggcatggcagatgaagtaggaaaatgcccgcctgctctctggtatctttagaaatactcacacccatccagcctatgtaggatacaatgtttttcatgaagttttatgaagattctgtttttcccaaaggagaaatagccaaagctgtgtttattgatagctgtgatgaggaaaatgaaggccaacaggtagcagtggggtctggtgctgtttataccctttagggaggttccttcaagtcttcataccacccattacaaggaaaactttagcatccgcctttcagggtttccagatcttagagctactgtgaaggggatgtgtcttcagagaaggggtgggcaaaaccaggaggtttttgtaatacacttacacagtgtgactatgggaacaacagactcgcttttgggaaggggaaccaagtggtggtcataccaagtaagtgagctgggatcctcctgcacaaatggccacagccacccccatccctaccctgtgctggagagcctcttatcatatttccatgggagcgggggaaggacatgccattcatcagtgctatatcgaagaaccttaggcggccactgtcccaaatctttgcctgtccctggtttctttcactctccccttctctgcatctccactgaccacactcccattctcatgtaagctgcccctgatcttccctgaggctggatttcagattgaacaaaggaccacaaaagtgagagctggaggggaccgtggggacatcttgctcatgttgcagagggacctgatgccagggtctagcatctgtccaagaccgtgctgatggtcagtgcacagcagtggaggggccccagccctttactcccaccctgagtttggtggagccacacagctctttgctaagtgaccctcaaacccagtgtgagataagctgagtgttgacagtgcccacctgctagggaaccaagtactgagttcctgccccagctcaggactgtggcgcaggccatgacctccctgagcctcagttttcatatctctgaagtagacagcatggtctctgtttcctcccatctttcaaaaattctatggaaattattgtgacttttttctctgtaattgtagggtttcacagaggcagggccttgtctgagtcaaggtcattagaaataaaggaatccaagggctttggatgccttggcctaattctaggtggtaaagagggaaggatgaaagcacaaatcacaggaagtgcctaaatcctgcttggatttagtgttgcctcaaacagggatatgcagaaatccaaccccagggtctcccataggaagaagactaggagtgggaagtgccaaagagctctggaaaggaaaagagaacaaggagcactctgagaaaaggaggtcagaacagcttcaggaaaaacgtcacataaaatttcctttgctctctgtcctcgcagcactttcagaagctccttgcatctgactaaagagtagcagagccagaccctcagaatgtctgccccaagcaagcagagtgtggtgtttgtattggggtgctgggagcagacatggggagttgctgccctgcttctctgctgatgggaaggtggtattttcccctgggtacacgggggccaaagagctctccagtccccagcccctggctcccgcccctgggctccagcactcgggggctctaaggacagcagtaggagactttctacaactcagagagtattcaggagggtttcccaggatgttgcccaataccatggggcaattggtagagggaggtcacatgaaacaggttttatcaaaggctgtcctcactgtgtgcatcaggaggaagctacatacctacatttggaagaggaaccagccttattgttcatccgtgtaagtattatagaaatgatcaagggaaattttgcagacagattatattatggaaggatactgtagtagtgagagtttgtgttgtgatctattccatcattaaaggagtcctttgttgcctgggagtaactatcagtgtcaggtctgatgagatgattgaggctgtgccggacaagggttttgcacaatgatttcagaggacaaatccccaagttgtgaaaaaagacttcactcttggttaggtttctaaaacagaactttcttcttggcaaccaaggggtctactctgccccctcactcctatgtctcttccacctgagactctgtcaccacctcccctagaatccgtgagataccttcccctgaattagagcataccagccagggtgctgaggcactctgtggtactggaatggatggtacagggatgcgtttctgggcttctggctgcaagaagcctcatcctttcccccagtgtaaagcattgctgggaatcatcccattatgagctactatttactgaatgcctgacacgtaccagtggccattctcttgtcttttatgtaatcctcattcagtgattacacacatcctaataataggtagccgatattttgcccattttacaggtgaggaaacagaggcttgggataagtaacttatccaagattatatagccacgaatgacagagctagagtttaactcaaatctgtttgactctagggccttgttattaaccgtgccaccaccatgcctcctgcattctgtgaaggaagacttcacacctcaaaggccatctgtttggcctttggtttgcccatcctgagccttcttaccatagcgaccatggcatggtgactcagcacttctgaagagatcagcagagtcattgggttgggtggcagaatacaggtatggcagggagggaaggagaaacttagggggactgtttattgcgcatacagttagagagaaagaaaaatgtatcaacaaaccatagaataggctgcttaaaagtttttctcccaagaaactgtgagtgtatgagggtcatgggcagctgcccccagctggcagagggcaggattttgtactgtgatgtaccagggtgtggacacgggcaggagagcacttacttttgggagtggaacaagactccaagtgcaaccaagtaagtacccaaacttaggctctggccaaagacacagaaagcccctactctgctttcttagatgatgaatctgtacttcctgaactaatttttcatgtttctttatgaggcttgaatatcttgaaattttaattcctagccactagcttaatagtctgttttctaacggtagtatttgccaatgggaattggccatttcatcattgcagagacagattcctttgagacaaaagatctttatcagaaaagaaactgtgactgattatgccaaaagatttatttttgttccatttagttttcatgaaaggtgatgaattatgcttcccaaagactctgggcattggacacactttctcaaaactgcacatccaattgagagatataggaagaacttagagcctaaataatgccataaaaataataaaaagtttgtaaaaaggaaccatatagaaattaaagaagaaatgaaatagtcttaatgaaagaagataacagaactgcattagaaacgaatggaaatatttagagggtttatgtattcaacaaatatttattggacaattattttattccaagcactatgttaagtgtgaggaagggaatgggagggaagggaagggaaggaaaggaaagaaaggagaggaagtagaggaaggaccgggagggagggaagaaggaagaaaaggaggaaaggagggaaggagggaggttctctttcatccagggaaggagggagagtctctgccatccgggagctcagagtgcaaacagacaactatagcctattgtcaccacgtcatagtggaggtacatgcaagttgcaatggaagcacaacagaagacatgactagcctccaattctcattgcctggtacatacacacatcctccactataccttaagctccatgagggcaggaccctttttcatcctcacagctctacagctcagcacaatgcctggcacataggtgtcaccaaacaaatgattgtggggaaaaaaatgccttctggctagatgagttatgatttatacattaacaaatattctctaacagagagagttgttagacctcaaaaccaggagattgcagaatccatccagatgtctgtggtgggagaaggcccatctctcagggaagagcacctctgtatttatctgttcatatgtgtgcttcatcaaagcctcttctcagccatggttcaggctgaatttataaagcttgaaacctatcgtatttctcaagaatcagagatcagaggtggaaggtttacaatatctcgataagtaagcagtacaaatgagttctagcagtaaaaaagaaagaggtctaatgataaatatatgaagcctgtctccacttgagagacctcctagaaaagatttgttctaaggaaacttttctccattaggagcagaatcatcttggaaatatacagctccaagttgtgttagaaaggtgtgtacaaagaagaccaaaaattcacatttggaataaggcattaaagttgccattgtttctagtagggaaaccctgcaaagtgttggggcatcgtagatcctgcatgttgacgcctgcaactaatctgccccggagctgttccgacagtggctggagcatttgctgcacagttgcataggtgttcaacaattgccaaaataaaatgaagctatttcgtgatgattagaaagaaataatcagcatcaatgaggcctctgatgcatcttcaggagtgagtaggtggaatgaagacctggtaggtgagacttttctctcttgtcagagaaagtttgacttgggggagcctggaaaacagggacaggagatggagtgccccagccaggcatgccctgcccaggtcagagttcttgtaaagcaccatctgattgtgtgttttctggtggctacaataagctgatttttggagcagggaccaggctggctgtacacccatgtgagtatgaccctgcaagtgaccagtgcaaaaagaactgaccacttgtctatgagaaaacaggtgatgatctatagcaaacttggggatatattgagaagcactcattttccattcctacaagctctcttggtgacttaaaatgttcccatttctcatatgaaacacagaagtgccaagagccaattgcgtaaatgaaaatctgagcagaataatttatagaaacataaaaagagttccaaataatgagtgctttcaagtgaagctgataatatcggcaccagataatctgaacattcaggaaattagctaagtgcccttgggggaaagagatgagttaatggcaaacacaaattctcttttattgcagcatgtagctaaattccctggattggctaataaacatggtatggggatccctactcatagaatcttcctctctggagttaggagagttttcagcttcctcctaagggtaaaagtggcccagacccctaactgaacggcaagtataccacatgcaattacaaggtatagaggcagcaatgtagagggaggcccacagacctggggaaaatctgggctctactctcactggctgttttcaataaagcctccactttctcagcagcaaaatgactataactacatcataataatatgagataatggccagaatgtaaaaagtgatcaataagtagtagcttttctaaaatattattataattattattattgaggctttgcttatactaaggtttacactatcataaagggaaaggagaatcgcttccttgggaaataaaagatgtaagcaacaaagacccaaggagccttttagaatgttgctctgggaccccagtggcttccagcagattagcatcaagaaggttatctcaaagaccttacccacagtgggggtacagcagtgcttccaagataatctttggatcagggaccagactcagcatccggccaagtaagtagaatgaagcaggagagcaagggaggacggacaactatttcttctttgtccaaaatgccaacttgaacccaggtattttcctctgtgggctccaaaatggtttcttccacccatccccagaaaatcctcccatccagctctcggtgctctgcagacatcatccttaggctgggaccttaggaaccatgaggcaggcaatgagcgagtactcctgaaccttccacaaacatatccaagatactgctgcctggaattgaggtttttgttctagggaattattggtttattgaaatcatatgaagtcacaacctcagcccagggaatcacagcagaatggaacaggaggagaacttttgtatcagaagcgaaatttcagtgcaaaagagcagaaggtttaggcctggcgtggtggctcacgcctgtaatcctagcactttgggaggccgaggcagggagatcacaaggtcaggagatcaagaccatcctggctaacacagtgaaaccctatctctactaaaaatacaaaaattagccgggcgtgatggcacgcgcctgtagtctcagctactcgggagactgaggcaggagaattgttgaacccgggaggcagagattgcagtgagctgagatcgcatcattgcactccagcctgggcaacagagcaagactccttctcaaaaaaacaaaaaaaaaaaaaaaaaagaaggtctaacccttaggagtgtgattatcctgttctcctgccttgtgggggagatcagtgtttctcttatttaagtaataggtaggtcctgtgagtttgtgcaatggtgtcacctacggtatgaatactggaggaacaattgataaactcacatttgggaaagggacccatgtattcattatatctggtgagtcatcccaggtggcaccacgtgcaaccccatgggccagtgtcactaatcctttctctggagatatcacttattactatggtgaggcttgctgtagatgttgtaactaattttcttacagaggtctgggaagggaaaagcattactatctatcttgaatattcatgtttctctaggtcaaacacattaaaatttgactttaatcattcaatgggtattgtaaaatgccttctatgtgactatcactctataaaatgttagactgagtatgaagtgtgagatagattcctgtcctgtcctcaagtggtataaaaactagacaaaggtactgaactattgtaaattaagcagccagaaaactattttagtattgaccagttgatgatgtcaatggacacaatagagattcagaggggatagggtgctggctgagaagttggcctagactgagaagtttcctgtggtacaaaggattcattgagccctgaaggatggataagatctgtatgggcagagaaaggagagaagggaagttctgggcgtagggaacgacaagaaagaaggcatgatcttgggaataatcaaggcacatgcaaagtagcctaagtatacatctgataataaaattggttgaaaagtagtcagagaagatgtctttttaggcatggaaaaaggaaatactagagcattcaacagaatacagaaattagggccagggccagccattgggaaactgagaatccgatttagagatgcagactagaagtgaaggtgagagcagccagctatggtgccgcagacctcccctctccttcctcagtgggctctgagaggggtcatcccacaccttagaggaggagaaacctaagggattctgtaatagagacacggggcatggtatgaaagtattacctcccagttgcaatttggcaaaggaaccagagtttccacttctccccgtacgtctgcccatgcccacagtttcctgatgctcactaaagcctcggtgggacccagagtgactgtcactaattctgatttctgggtccctagtgcccaaacacgggggacagatttaatggtaaggaagctttcaatcactgctgtgtccctagggatctaaagcactagagcacatgtgcttctgcagttcattttgaatttaaaggacagcttaggatctagaatagctgaatttccacctcaaaacattggttccgtcttgccaagcctaccttctgatatcatcagtgatgggatgtgtttttcttactagggtagaataggatgtctctccccaaaggactctggcagacagacccctaaacacctccaaattaaaagcggcaaagagataaggttgaactagacgtacatggggataaaaagtataaaaggtacatgggaatgaaaggataaaaaggctaaaaaaattaagtacctctaactcagcccctgttgccatttctcagagtcttgtgttctgtggcattgcgctttctagaccaacagtgtccaatagaactttctgtggcaatggaaatgtcctgtcaatctgcactgtcccatacaatagccaccagctacatgtggctattgagctcttgaaatgaagtttccatttttaattgaaaacattttatttcacattgactaatttttatttcaacagccacatgtagctagagactattataccagacagagcagcctagatcttctccagtctgacacccaccagccccaggacttgagtgagtgtttaaccaggactcaaagttgggtttctgccccacaaggccaccccctttcctctttaaagccaacctgcatctggtggcccctgatcccctgccttgaggatcggcacttccagactcctctccccctctgcagtgctgtccagtacccccactgatgactaacaatcagggggatgtgttggtagagctaatggctttctgtctgtcccttcccagcaaaggaactatgccttagggccttcacccagagtgatgtcaggctgcccaagcatgaggagggaagtaggcagaatcctctggagccaaagctctggatgtctctcccctctgaccatggagcccacccctgctccactgctccagggacagccctatgctgcaggcagctctgcccccactcagcatcccaggggctgatttctttggttttggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacagggccttctaggccatgagagggtagacagtattctaaggacgccagaaagctgttgatcggcttcaagcaggggagggacacctaatttgcttttcttttttttttttttttttttttttttttttgagatggagttttgctcttgttgcccaggctggagtgcaatggtgcatcttggctcactgcaacctccgcctcccaggttcaagtgattctcctgcctcagcctcccgagtagctgagattacaggcacccgccaccatgcctggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccatctctgactttccattctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggtagcggaactcactaaggggcccatctggacccgaggtattgtgatgataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctgaggtgaggggccttgaagctgggagtggggtttagggacgcgggtctctgggtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgcacttctcccctatgaggtaggaagaacagttgtttagaaacgaagaaactgaggccccacagctaatgagtggaggaagagagacacttgtgtacaccacatgccttgtgttgtacttctctcaccgtgtaacctcctcatgtcctctctccccagtacggctctcttagctcagtagaaagaagacattacactcatattacaccccaatcctggctagagtctccgcaccctcctcccccagggtccccagtcgtcttgctgacaactgcatcctgttccatcaccatcaaaaaaaaactccaggctgggtgcgggggctcacacctgtaatcccagcactttgggaggcagaggcaggaggagcacaggagctggagaccagcctgggcaacacagggagaccccgcctctacaaaaagtgaaaaaattaaccaggtgtggtgctgcacacctgtagtcccagctacttaagaggctgagatgggaggatcgcttgagccctggaatgttgaggctacaatgagctgtgattgcgtcactgcactccagcctggaagacaaagcaagatcctgtctcaaataataaaaaaaataagaactccagggtacatttgctcctagaactctaccacatagccccaaacagagccatcaccatcacatccctaacagtcctgggtcttcctcagtgtccagcctgacttctgttcttcctcattccagatctgcaagattgtaagacagcctgtgctccctcgctccttcctctgcattgcccctcttctccctctccaaacagagggaactctcctacccccaaggaggtgaaagctgctaccacctctgtgcccccccggcaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctgcagaatgttgtgaggggtttatttttttttaatagtgttcataaagaaatacatagtattcttcttctcaagacgtggggggaaattatctcattatcgaggccctgctatgctgtgtatctgggcgtgttgtatgtcctgctgccgatgccttc

SEQ ID NO: 119 - DNA, 575784 bp, Homo sapiens
atgggctgaagtctccactgtggtgtggtccattgtctcaggtgagtcctgggcacaggtgggacatttctgtccttaaattttttgcttttttcatggaactgcttcagaagattctgtcctaggcttagtctgaatttggcttcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagccaagacacagccctgcagagtcaccgcctccctgtgcacaaacctcctggatctaatcagaaaaccgtgggggcaacgcatccagctgagcctcagcactcggttcagcattctgtaagacctcagcagacatctcagatcataatactgtcatttattggatgtggcaatgctaaattgcccagactcctgcagcctgtggcctgagtttgtcttgaatgagactgtgcctgaacttgaatgtaggacagatgccgtcaagtttaagtttttccaagtatctttcagtcggtttgtgcctctgggaaatgttgtgtgaggtatttaacactctggcctcaccaatccaccttccaatatggactgttttttgactttcttttgactcaagttagacccggatctcagccctcatcccagctccaaatatgtatggtcagaccttttcttttcttttcctttctttttttttttttttcttttctttccctcccttcctccctccctccctcctttctttctctctctctctctctttctttctttctttctttctttctttctttctttctttgtttctttgtttctttctttccttctttcttttttgagacagagtctcactgtctggagtgcagtggcgcgatcttggctcacttccacctccatcttccagattcaagcgattctcctgcctcagcctcccgggtagctggaactacaggcgcccagcaccacgactggctaatttttgtatttttagtagagacagggtttcaccatgttggccaggatggtctcaatctcttaacttcttgatttgcccccctcgggctcccaaagtgctgggattacaggcgtgagccaccgcgcccggcaggtccttttctttttctttctttcttttttttttgaaaaactaaagaatacccaatcccctcctcaggtggctctatcactgcctcaccctgaggacagtatttccccatggggtttggatcactgttctctagttccctctccctggggcatgtgcagagtttcaacttcttgttggctgctctcttccactcaggatttaaaacattcacacttgattctttttccttctatctctgtaatcctaataccaagttttcttggcattcattatcagccgtggaatctgttgtacctgaattgttactcacagcaggtaataagagaacaagacctcctggaatttctgagccagactttgtactcagggttaccttgctgacccccatattttccagcattgctcttattaattaatggccctcagtcctgcacacaccatcagatcccaggggctgagcacagcctgcattgtcaggttctgcaacaacacaaaggctccctcctctctcctatagagggcgctccagggatggtgggtgttgccagagacaccagtaattctgccagaccttgcctgtggggccatgggagctcaaaatgcccctcctttcctccacaggaccagatgcctgagctaggaaaggcctcattcctgctgtgatcctgccatggatacctggctcgtatgctgggcaatttttagtctcttgaaagcaggtcgatgcttagactctaggaaattcttgctttgaacttacctaagacaattctaaaccattctcttaatcttcttcttttctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgaagccacagccttgcaaagacaactccagcctgtgcaaaatccctcacagagctgcctccctcccagccgccagctcccacttcctgcctaagaaaaggaagtctctggttgggtttgttcttgcagctgtctccaaatagacagatatctgaaattaaattaccaaaggtatcttgggcagaaatgaccagacactgtaggatttgaagaatgtttacagatactacagagtgtgagtgtgatggtgggctctgaatatgagagaattgtacacaaccaagtaacttatatcttctcctcattcccatttggccatctttattagaattgttttgttttagttgcttaggaaaacatattttaacttctagggtggcgagatgattcctgagtgggagttcaggtatttccatgagaatatagagggtgctcacagaaatcttcagaagaaggggcttggtacaaagaactcaattatcaatgactcttgctcagcatgtggtcaagagcagaactatctgatgaccctgtgaacctggtgtgatgcatttgggctaatgatgctagctcacaaaataacaagttaagagagtagaaaacatggagtctaatatttcacaccatttcaaggtcaacagagttctagaccagcatgagaatcgccagaataaagcaaggcagtgcaggaacagaattcagcagcaaaagtcaagagacacctagaggcagaggcaggaatgaatttgtcactttcaacttaacctgaagcagccagattaacttcttgagtttcatttaagaaattattcctcttttaaacatacctattgaagtctaaattttaggtattttatatatttcagttctggaatttccatttaaatcttgctacaatttccagttgtttgctaaaattgcacattttgtcatttactttgttgactatattaacatctgtcattttaaagccactttttgataactttaacatctgaatctgtttgggtctatttcttttgtctgttttctctgttcagtttctgggcacgtgattttgttttctcatacaactagtaatttacttgaatgccggatattgtatataaaaactatagagataatttgaggctctgaatgatttcatcttcctcaaatgattcacttttgcttctgctgggattgtagcaggggcggatcaccttaattgagctgatgaatgagctggatcagacctgagcttcagcctgcatgatggctgctcgcctttgctcttagccatgtaagttccaactagatgtctgaagtttaacagctaaatcaaattgtaaattacataacataatatttgcccattgcaagcatgcaattcaatgaattttgataaatttgtggagttgtgcaacaatcaccatgatccagctctaaaacatttcatctttccccacccggaaagttccttcgtgctcattttcagtcaatccctgcttctacccccagcaccaaggactggggtctttgccaggctcctctcctattcagtagtcactgaacgtaaatgttctccagaccagaaaggtggtggatgctcctcaaagcctgctacactctcagtcttcccttttcttctcagctacttagccaacgatataaaactggcaaatgacttaaggcgaaagtggtctgttagatctctcctttctcgttgagatcccaatcccttaagttcttactgcctcagtagctccaagtgccttcaaacgtttatttttatattttgttaagtttttctagttgtttttggtgggagtgttgttctgcaaaaaatcagtctattaactctgaaagccagtttctatatttattaaaggtgaggtgcaatgttttatgtttttattttaggtagaagtatcttgaagaaaggaaggagtgaacctctctgccttcccttttttttttctttttgagacagattctcactctgtcacccaggctggagtgcagtggggcgatctcagctcactgtaacctctgcctccggggttcaagcgattctcctgcctcagcctccggagtagctgggattacaggcgtgcaccaccacacccagctaatttttgtatttttagtagagatggggtttcaccatgttggccaggatagtcttggcctcttgacctcatgattcgcccgcctcggcctcccaaagtgttgggattacaggcatgagcctccattcccggccagattatctctatttctaagagttctattagccttctgcctttggtccaccatgggacagagtcttgacacgtttgaccttttaccacaaggaggagctgtgactctactgagattaagggaactcagaggaagggcagagcattctcaggatgggagacagttaaaagaaatattgggtttatttacaacaggggaaaatgtggtctgcagaagctgtgttaatgctgaaatgtgagaggataaatatagactattcatttgccttgctgtgcaggtgcttttgatctagcaaagagcctagactgccagatttgttgcatgtgaacctgcatgggatgagaaagggagagaatttgagctgggaaagagcagagctcacaagcagatgccagtggaggaactcttcctgagaggaataagagaggctctggatgctgggcctcttctccagttcaatcctgccatgaaatgacttcctggaacctgggcagtgagcctgacaaatcagggcttccttgagggatcttgcaaagagagtaattaccaagggaaatctacctatcagaccaaagaatacctggagcaccattctcctgactctaaatgatgaaaaacctaagctagaaagggtttttttttttctttttcctcttctgaatgttcctctaagttcttggagtgagggcttcttcgaaggataggaaacctgtctcctgggtctgagctaatggttctatcaaaacagcctcaccagactcccttccagcttccagcttcaatatctatccctgtctaccaagacccatggaagctagacttgtccagatatcaaaagatgatgccaaacacctggagatgggaaagaaggtggcgtggacagacctccaggatgcacatctgaaacaggctcttcattttgttttgactacagcctcctgtttcgccttttcaaaaagcatttggaatttcccttacttcttggaaatccaaaaatacagcaaagatacattttctataggctctagttattcagtaggagggagcttcagaatatctctatactctactatgcatattctagcatgctgcccggaagtgaaagtctagccaaacagtttaacaggaaaaccgttagctgtcctgtggaggttaattttgcagtttattttggaatggaacaaaagaaggtattgaagataggaatctcatttctatatgctagaatctaaatttcttaactttctgtagtatgggccattttcaaatcagctaaagtcctaaaaccagactatgggaaacacacacttctaagctcaatattaaatatctaaagtgactaactaacgtagggttggagaggcagggtccccctggacttttcaaactcctaccctcacaaaaaatctagaacttcttctcagtaacaaaaataagatgacgtataatcatttttcattgttaataaataatctctatccatcatggcattgcattgaatttgtgttaattgttgctaaaaaatgactgtgggttaaacatttgtgattcatataataatagaaataataaatgtaaatgttttaagtgaacaagtgagattttaatagctcaacaggcaaatagcatgaactgatgctctgcaaaggtgagggacacctggcctgagacaggatgtcttatctgattttggtctgaatttcatttggaaaactggcagctgctggtcaacctgcagggatatgatcccatgagctgatatgcaatgttgacttttgtatttttgtcagcatgaaataatttttttttttttaaatcagggtcagagtctcgagtaactagcagccagctgatagaatggaagtgaaaccatggccctcgtccccttgcaaacctggaaacccagtgttgagcatgtgtgaagagagaaacagaatcaggtgaaatgaaatcttcctaagaccctgctcaggaaactaaatttgacgtaattggacacaagaagttgttcatccattctattccgccagaggagacaggacagatttcccgtgcgttcttgggaagctggaagagggagacagctctgccaggtggagtgatattctcatgagaagtgaaaaagaagaggcagagatggagagtttggttctagaagggtggaaggttttgcttataaacatatcaacacacttgcttttcccgccaagatgcaaactttggggaattgctcaaatataagatggggtttaaatattggacagccaaaaatatgacccatgttcaaaatatgcatcctggtatcattcagttcgacgtgttctagttcttctgcagctttctgtctcattccttttgcccctacaactctccacctttttgtggattaagttatctccatgataaaattattatgttgtcttccctctttgactttcttgtcggcagcctggctcttcccagggatcccagcgtctatcctctctcctttctgtagcttttttccgcttctccagtatggcgggccctgtcagaaaatacgtacataatcaatttatttgtccttcttatcctttggacaattcttttgtttgtttgtttgtttgtttttggttgagaccaagtctcgctctgtagtccaggctggagtgcagaggcaggatctcggctcactgcaagctccgcctcccggcttcaggcctgcctccgccttcctagtagctgggactacaggcgcccgctccacgcccagctaattttttttttttttgtatttttagtagagacgggtttccccgttttagccaggatggtctcgatctcctgacctcgtgatccgcccaccttggcctcccaaagtgttgggtttacaggcgtgagccactgcacccggtctagacaattcttgatggacaatcaaacacttttgcttttcatatctcctgtaaaacacaaaacaaaacaacaaccagaactaacattgcctcatatgaggcgagtttctttctatcagtttcattccagtgcctctcccagacgctgtccgtctgatttggtaaaaagtcttgcgtaaaatagtgaaatacatatttatttaaagtctactctttaagaatggttacatctttacatagttatgatcatcaccattgaatgtagcctcttgtcatttcactatcttccctccccacccgttccttctttgaaaaggttcccatgtcagctgtgtggtgcaatgtggtaggtactgaataagacccacaactacgggggtacctggttatgttcacagaattgtagagctagacagagtgttgaaaattatttatttctgcccattgtttcatagatcaggaaatgggatgctttaaaaaaagtatttaaatgtaaatagtaactattttgctggcctccatgtaatatgtatttcatattcttagtctacaagtaatgtgtgaatgtgtttttgctcctattggattataagcatcatgagagtgagaatattgtttactcatgctttgcactaagtagccattcagtgactataaacaaataaagcatgcttgaagttccaagaaggatggtggtcatttttcttttgtttagttcaagttctgtgtttagtaaatcacaaatgaaccatcaaggtctgtctttgcaggggattcaccagtagatgacaacactaccaaagtgtgtgtgtgtgtgtgtgtgtgtgtgtgtgtgtgtgtgtgatacctttctggcagtgctggtctctggttttcctcctggaggttcctgccctggggccattgactgaggcactgaggtctgagtgctggaccttgctgacaagagcaggaggagctgcagccctgccacacccccgaggttgggtggttgatggctggcagaggagaggagtaccatgggcaagaataaaggggactgtggtcctcaacattagataattcacaaaacgcgaaggcattttctgtcgtcacattgccatcaggtgggtagggcccaaggatgccgccaagcatcctccctacacaggacagctccccacaacaaacaatcacctgatccaacatggcagtagtgctgaaattgagaaaccccgcaataagcttcggttgtaaactttgtaccaagaaggagaattctctgcagacaactcaaggggcaataccgtcaactacttttgttttctctgactgccgtgttgttgaccttcatcgccattctttcccagcacatggtgtctgcatattttccagcagcctcctgtttcctcataaatctgccccttggacagataagaacatcacagggagcagggctgcagttcactcccaataataacgcctcagcagggtttgctctgcagtagcatcacagtcatgtggagtaggtggctatggctggtattcaggtgaaatctcaggccaatctctcctgaatcaaggggaccactgatcattaatgagaccttcaagtgagcaaagattcaagagagcaaattaatgtcctgcgctattgtgaagggacgcaaaggatccagagaggaaaccagctgactctgagagaagggcctgaaaaggagaggaagggaggaggtggtcagatccccgggaaggagcagggagggagggggctgctggcccaggaatgactgtcagagacacatcctggaggtcacaattccaccctctcaattattcccagaaattccaaaaactcctttaaaggagcaagtgcagggcatgaaagggaggagccatgctagaggagaccctgggaatgggggaatgattacaggctgtgacctcactggcgcagcacctctcagcggcagtggaaaccacagcctagtcctctcaccactgcagaccagaatcctgccctgggccttgcctggtctgcctcactctgccatgggctgcaggctcctctgctgtgtggtcttctgcctcctccaagcaggtgagtcccgggcccaggtgacatgatcctattggagtccctaagccttttcaccatgacaacaacagcaggccgtctcctaggatttgcctgaattctgcttctttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagccaagacacagccctgcaaagtcactgcatccctgtgcacaaacctcccggctcagccaggaagctgcagggcagcgtgtgcacctgcacccagggctccagtctccattccctgatggcctctgatggagtttcagtctgtagtacagccagctagtgcacccagtggagaagtcctccatcttatgcacacaaaagtctcacagaattgtttatcagctagagcagggcttcacaacaaagccactaaagtattagggctccacaaacaaaaaagagcctgtcctatgcactgatgatcttaactgatgggggaagctctttcttttctttctgtgtggcacatattggtacgtattttatataacattatgaaaaaaacacgattgctgaaaatggttgatgagcacaagcataaaggagggggaaggaaatatttccaagatcaagagacaattctgatgatcagtgagtactttattcaacagaaaaatatttggagaggcatgaaattccatggcaataggtaaactggaaagtgttgaggagatgccggtggaggtagccttgtgcgttgtgggctccttctcttcaagaagggtgaccagcaagtgtctctcccaattctgatgaatatcatcttgaactgtcctcaacagcaggcaatagccagatgactggggatattgggagacctgaaaggactttggacacaaatctctaggcagtggtgagccattggtcctactccaagtgaaacaacatgatgaaactgatattttggtagaggaacactggtagtagtatggatcagaaaggagatagatttttgggtggcatgaatgattaggagacttctaaatatcctacatgaaagattagaaagggttgatgtgaagcattgtggacaatataggcttgaggctctgcattatgttatttcttggaaatgtattgggttttattctgggagggttgaatgtaggacttgctagggtctatttcagccttgccctccctcttagggagccccagcatgtggtcatcattgctagtgcatggcctttccagggtcttagtgggaatcacagtcacccaccacgactctccactctcactgggtctgaatgccattgccttcctgccctgggtatcctctgaaatccctgcccgtgtctacagccttccagagtttgttctctgctgggccttcgggagtgccaccctctgcatacacaacttaggacctggcccagaaagaaaaataaaaaatgaaaaaagattttcttacacaggttctcagggctccttggtagtactctgtgtcctaaatcccagctgtcttggagtcagttatgtcctcttatcttcaatcacatatactacttctattttatataaatatgtttacttggcttttcttcatatttaccattccactcttcactcttcttgcaattcacatggtcctgagatcattttccttcttagatccatccctaattcagaccacttgaactcgctggtcaccaccccttgttgtgggaaatgcttatgttagctgttgtcctcaggacaattaaacctttcgctttcaccattattcaagttttcagtttaaattctattgctttttttaaattgtctttgcaatttggtttacttattgagagccaaacaatgcaataaaattttattcgttcaaatttgttctactttgtagaagggccaaagtgttttcttgctgaagtagataccaatggaaacaattttaatggtaataatactagtgtttaaaataaggctaattttaggtttttatctagtgaatagaatatctccaactgtagcaggatagagatcgatcctatatgtaacctgttgagggggagaatactcaaccccattaaattctaatctacatgctttacattttttgtttgtttgttttatgggccacattgaaaatctgatgaaatttttgcattagaagaatgctacaattttcctcctgactgagaacatccccaggttaaaacaaatctaaattataaatccttgacttaaatcatggataagtatcttccctcagccccatgtagatttacatataacatagatttacgaccctaatctcatgcctacaattataattatcatcatgaaaaggtaacactgatgtaatacaacaataaatagatggtaaaaatcactttgaaagtatgaatcatctcatttttgtgtttatttgtgttcatttgtatctccaaatgctctagaatgaaaagccaatattggcataaaagtaccttttaagaaaattgatgatattccaattcttaactggtcacaaagcataaatagcttatgcagtgaagtacagaagacccataggaagtcatccagctggttcctagttggaaagttctccacagaactgatgaactaatgtggtttctaacatcttagaaatggcagggctttagagatcatctcatttcagttctcctgatttaatatatgaggaaatatggcatcacatatatgaagtgattgaacaatgacatactgattacatttctcaaactttatgtaagatatatttttattctctagttgttttctgaatatgttgaattgccttacacaaatagaattctgggggtgaaaatgttggtgattttctgcttgctcctagctgttgctcaaggagtatttgttgaacaagtcagactggcccaagaactcaagagggctgggatactgtctgttctgcacattactagagatccaggcatagacaattttctgttcttttttcttttctttatttcatttcatttcatttcttttccttttttttttttcttttgaggtgtgtggtgggagcagggtcttgctctgtctggagtgcattgacacaatcatggctcactacagccttgacttccatggctcaagcaatcctcccacttcagcctcttgaatagctgggactacacacaggcaccactacattccgctaatttttgtagagataaggtgttgccatggtgcccagacacagacatagacaatttctgttgagtaaaaatttagaatgtcttatgtgtgtggatacctggcgttctggctgctgactctctgtgttgttgccaacacctccttcgtcttcattctcccctggcctttcaaacccttctctgctgctcagggttgtgagatgtggaacccatctggatgctgacactgggtcggtgagtggccaaatactgttttggccacaggcaggagctgtgctctggtgaaacctctaaggcagggacctggggaagggatagagaataagaggagagatgggccaggagggatcttgcccatggggagccaaccgtgcctcaactgagagcatggctgtactcagcccaagcacactaacatcagcttcaagctgatttccctttcctttgctccacacaccttgtgttgttctttttcagcatcctgtgtatgttagctctaagcccagccaagccccatgccctccacttcagggacagagggtggctcatcccttttgtgctccctcagctccctccccagtgcctggtggctggttggcaacacagtcatgcccttgaatgatgggagctggtgcacactgcatccgtgttcatgcagtcaccctccctccacagagccgggcagaaagggctccaccacacttagacattgagggaagggacgttttgaatggcactgttttatgtgatcccgcaggacagaaggagatttcttgaatgggagtggtctgttgttgagagggatcctgaaagacagggagacaaagatagagggaggatccacataattaggaagcagctgagagcaaaggagcccctgccagaggaatatccttggggggtaaaaagccagctctgccctttctccccagccgattcatcctagcccagcaaattcaaatctaccttctatcagaacttagaaaggatgtaaagcagtcaggaagaaacatcccctgggtctggggaaactatcaggagcagtgacatcacaagaaaaaccaccaaccagggccaaggagaccagagcccagcacctcgcccaaaggaccccagtcagaggccccatctcagacccgaggctagcatgggctgcaggctgctctgctgtgcggttctctgtctcctgggagcaggtgagttaggttgaaattgtctgtccttggactccaacccttttccttgtggctgcaggaacaaccctcttcctgggctctgcctgaattttgtccctttcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagccaagacacagccttgcagagtcaccgctttcctgtgcagaaaccttcggggcctgccaggaagccgtgggggccacggagggctcgggtgaacatttcctccaagagccccgaagaagcttcagaacatcatagcacctgctaattcatccatgtggcaactttacatcctatgacatatttagagtgtgggtttccttttgcctgagtgtgactctgccccgtcaactgatttgaaaaaagagaaacatattcagatctagtttaaaaaaaaaaaattttttaatcatgaaataggccgggcatggcggctcatgcttgtaatcccagcactttgggaggccaagacgagcggatcatgaggtcaggagtttgagaccagcctggccaacatggtgaaaccccgtctctactaaaaatacaaaaatcagctgggtgtggtggcatatgcctgtaatcccagctactcaggaggcaggagaatcacttgaactcgggaggtggaggttgcggtgagccgagaccgtgacattgcactccagcctgggcgacagagtgagattctgtctcaaaaaaaaaaaaaattcctgaaataaagcaagcatgctgtaaggattgtgtagcttaaaattttataagaaccctctaaacaatcacctgtgtcaccacagaggcacaccctgcactgggtcagacactgtcctgtgaggagctgtgttctcctgacacttcatgtccagtggtttccatgactcttctttggggccaagggttccctttcatcataggttgttgtcatgcagagtcaagcaacactgagcactgggaaatcagagaaggaacttccaggcaagggtcccagtgcagaagccagctagagaggacagtagtagactcaccctttgggaaatatgtttgagaaatatgtatctattttcaccagttctattactctatattacagcttgtctattctctaatttctcatttgtacactgaaagctagactgtgaattctagccctgatcaaagctccacatatacacagacaccttctctgaaccctgcaggcagcaaacttgcctctgtctgctccccttgctgcagagtccatggatcatggtctagaagtttcctgactcatccactctccttctcttggctggaagcctccttgttggtttcagatctcagcgcctccctggattgcctctccagactgacacttgaaggattatttttccccctttggtctctttattcccaatgtgttcaatcatcaggctcagagcctgatgcctccagagcgcagctctacattagcttttagagaggagagtgggtcctggctgttctgtttatctgttttcattcactaattcattcattcatttattatagagacaaaagattccctatcccaagatatatggtcatctgtgctgtatcaaaagagaagatattcttctcacagttttatgaaatgaggtagcttcgcaacttgcggggagcagcctcttaagttagttgtcaaaattaggcttttgcctaagtaaagttaggatcctaaattaggctcctactctcccacaaaaactgggagacagggcctctatcttccttgacgattgtatctcaaaaagatggttcctagagtcttgggaaagacattcctgggtcataaagctggctagaggtttacagagattttaataggattgtcaaaaagccttttctgtgtttattgagatgatcatctgggtttgtttttagttctgtctatgtggtgaatcacatttgttgatttgtgtatgttgaaccaaccttgcatcccaggaatgaagcctacttgattgcagtagataaactttctgatgtgctgctggatacagcttgccagtattttgttaaaaatttttgcatcgaattaaataatttttaaataaggtgacttacattaattgctttttaaatataaaaccaattatgcattcctggggcaaatctcatctactgattagatattaacctttttatacattgtgagttaaatttactttatttttgttaaggatttttgcttctatgttaatattagtactatttattcttcacaatttgtaaattgataaacttgctcaatttcatcaataaagtaagctgggcctggagttttctttctggaaatgcttttaattattatgagttcaatttttaaaaccacttctacatgtattttttaatatccctatggacattcaagttatccactttttgagtgggtaattgtgttttttggggaatttgtttattttgtctgcttttgaatttattggcataatattaatctttcattggagttctaatttgcatttctctaaggattaatgatgttgaggacattttaatgtttttattaccatttgcagatatgtctttttcatatacctattaatgcttttgcccagttttaaaggttaaattatatatcttttatattgatttataggaatcctttataaaatataaaggatttttatattatatagaatcctttatataatctggatacaatattctagtctgatatatgtattgtgaaactttttcctcagtctgaaaattttcctttccactttcttggtagtacctgggcacaacccctatgaaatgagagtacccttctgtctcctttaattttgtctctctaccttcacccttatcagtatttggcaggcaattaattcagtcagattgagagagtgcaaaggcttctagctagccctcacaacactggcttgggtacacctctaatctccaatcacacgaaacaatttgccagcccagaagctacccctgctatgtattctaccatgagtagaccttaaatgtgcacctcccactctctccatagtacatatggtagaatggtgatggatccttcttttggcagactttccacaatgcatggagctatgcctatccaagcacatctctgcatggacaaaggaaggggtggataattgagtcagtgtttctgcttcttgcttgtgagttttccccagtaaatcttgttttatgtgtatattgcacagggctagtgctgtctacatgtcccttcatatgatggtgctctcacagaattctgaggctggaaggaacaaacaaaagttctcataaagagaaatttaatcacctctagaaagaagtccgtgcttaatggctttggagtttctgtgaagaaagggtttcctcctgccttagaaggtgggcaaagtgagcaacatcttcaccaagtcaggaacacttgatttcagccagaggcagaagtggggttctatgataatgcccgattgtggttacagagggactacatgagcaaggccatggaggtgaaaatggattcatttgggctgaaatcctgtaaatgaagtaagcgggaaaacccagcgcacattccaatggaagatgcagcttcctaatattgtgctttcaacttagattctgtcatctgtaattactccacacactttctcaaatcattagcacaactgtgggccaggtaatcatttagcccctttgcttggtacaaggtagccatgctctctacttagctccctatttttctctgggaagcttttgctgagacctgcagtgaccatgcttctcagacttctctctttcttattgtcatttccatttatattttaactttaattgtagtttatttgattaacatctgacatgtttatgtttctcttttgcttatttgacctcacttaatgataacccaggtaactggtcagctgctgctaatcaagttatattttctggggttacattggttattttttcctctaaagtttctatctgtgtaagaattgaggtagcagaaccttctctctcttttttttttttgagacagagtcttgctctgttgcccaggctggagtgcagtggtgcgatctcgactcactgcaagcttcgcctcccgggttcacaccattctcctgcctcagcctcctgagtagctgggaaccttctcttttttggaaacagggtctcactctgtcacccaagctggagtacagtgatgcaatcatggctcactgcagcctcaacctctgagattcaagcaatcctcccacctcagcctcccaagtagctgtgactacaggcacacaccaccaccactggctaacttttttgtttacatttttggtagagatgaggtcttgctatgttgccaggtttctctcaaactcttgagctctggtgatcctcccgcctttacctcccaaagttctgagaatacaggtatgagccaccgcgcttagctcctcctattgatttctgaaatttaaatggagatcagactgtctccacgcaaggaggaagtcagacagggcagagcttaaccaatgtccacggtttgttttctcactgcagtcttggacttaccactcatctcttcattctctggctcaaaatagcttcagtcttcccagaagattctcatgattttcagtttgtttctggtttcttagttatttcttgtctcatcaggctcccctgaggaaggagccaggagatgctacaagtctgcaattttagggggagtcagatggagtgcactggtcttttgcacttctttataatattatctaagcctcctcttctttgaaatataatggctattcatcatgggatatgaggcatctcagaagcaatctaaatatctgtttgtttctttttctagtaaagaattgaccagtattctagcaattttattttaggtattcctttaaaagtaaaaaatacatagtttttcttaacgtgacttctattgatagtttatatttttatgattttgtgtagtagctttaccttccctaggatcagaaaccacatcagataatcagcttctattatgaaagaagctgattcttctatttggagagtgaggtatgcagaaaatccataaaaggtattaagttatagaacaccaccatctgatccaccatctgatcttgagagaattttaactggtttatatccatgaatactccctcagtagggtatttttgttctctggatggcatcttggaagaggtactggtcattgatcatatctcactggcacattggctagtgaccgctaatgtcacatgcagctggattggaatctcttctcattgctttctcatggggtcatttgcctttggacttaaaaatcaagaaatttcataatgacaatatctagatttactgtatatatgtaactattcttaaaatttgataacagatatgtcaaatgtagatatttaaagaaatttggattggaaatacactaaatcagaagtagcaagtgaaggatagcggttctgtaatggaatctttctcagattctgttttccctagtctcatgtttcttttttaaacccagtctggcctctccttcttagcttactaagtatagaaccacaaatagaaacttagaaatttaatcattttctgcacatatctttactcatatatgggaaaatgggcaagaggatattgtcagtgaactcaggcaaaaagaggatttctaaaagagagagtatagatgggaaagaaacaaattccccagcagcatgggaacagtgggtactgttttgtttatttttggataagctgattagttggcatgtagcacagagtggtctgaaaggtcttcttggagcaagctggctggagtcatcacagaaaaaagaactttaataataaatcatccacaaatccctgagagtctgcctgccgcaagggagacgggatgacttgatgtgattctggcacagttcttcctgcagcacacctacctgagctaggccaggtttgcatcatctccttcatcagcattttctcaaaggcaacatttcttttctatcacttttttcccttttacagtgcaaaaagtgatcttgaagaacataaattttaaaatgtgggggtttcttttagttcccctagagaaacagtataatagtcaagatggtgaaattgttcctaatttaaatatgtcccatgtctcttgcaccatgttagaaaggctgtatccatcagctcagacagccacagcaaatagcacagactgcatgggttaaatacaaatctttttttttcacaactccagagcatgaaatggggatgccagcatgtggggctctggtgagggccctcctcttggcttgcagagcaccctcttccagttgaatcctcacatggtggagagagaacaagctagccatcaagtgtctcatctcagagggcattaatcatactggatcagggctccacttttataaactcatgtaaacataattttctctataaagaccctattgtcaaatattgtctccctgggggttgtattttggagggacatcaatattcagtccactaacaatggcaaaatcttggttactgcacagtgggccacatgggggtgctgtggaaccactgagctccaaatgtctctggggcatgcacagagccaggagcctgggacagggagggttaaggagcagccttgcttgatgtttgtgctcactaaaaaatgtgatgacggatacataaaactgcaggtgtgcctctcatcagggagccatgcacttcagctatgcctgggttaggaagcctctgtgagccgaagagggagaatgaagatgggatgtcccatgctgggatgggacaacctgcatgtccagggcagggacagatagaggaacaactgcctggaaggaaaagcaaaggaactgtgggggggacatgcagcctaacctcagtccagccccacatggtatgtgagagtattaacagcacaaagcagaggtcctggatcgggtaagccaggggcctaacaaggaaggcaggatgcatgggaacccgcagagatgacatcagagtagtgatatcacagcctaacatccgatcagagatgcaatgcccaaaaccccagctctcagaggaccagtatccctcacagggtgacacctgaccagctctgtcccacctggccatgggctccaggtacctctgatgggaagacctttgtctcttgggaacaagtgaatccttggcacaggtgggatgtctctgaagcacgcctcatccaaggcaccctcaggctccctcctgtgttcttgccctagcctctgtctccctccctcacaggcccagtggattctgctgtgcagaacagagagcagtggacctcaggaggcctgcaaggggaggacataggacagtgacatcacagtatgcccctcccaccaggaaaagcaaggctgagaatttagctctttcccaggaggaccaagccctgagcacagacacagtgctgcctgcccctttgtgccatgggctccaggctgctctgttgggtgctgctttgtctcctgggagcaggtgagtccctgcagacaggatagcgccccattctgagcctgtcctcacccctgtgtcttccactttaccatggggaggcaccaccaggctgtctccggtgctcattctccatctgcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcagcttggcacagccctacaaagccaaccacattctgtgcacaaacctccctggcccaatgtggagcaacctcagccctgacatatctgtgagaacctggggactgcagggagaaagaaaggcaatttagaatgctaggatccacagcctggggctttctgcaactcagggctggggaaaacaaggccaagagagcctgctcagaggatggtgctgcttccgtaggttgactgcagcattaccttctttgccgacactgtgaactacaggagtagaggaaatgtgtgtaatttaacagctggcgcactctttctcaggacaagagatttaattttgtggtcaagattgttgataacagtgtagtgtagaagggagaatcacagggtttgctttatacaacttggggagaagaaattgaggttttgggaaagtcaaggagagagaaaacgaaagatgattgaaaacagagatagagcagaaggtgatgaaaagtggtgttctgtgcaccatgaactctctttcccccacccgaaagttttcaacacctagaaaaaaataaggaaaggtcttatagccaccggaatcacctggtagccggtcccagtcggaggcatcaccaaattgccgcttggccattgtgagagccctggagttgcttctgctgtcttccttcttccagccctgatcttgactcctcaggccacagtcaggtacttcccaaaacacagaggaaggtaaagtcacccttcttcctaaaggggcaaatactttccagtttccccccaaataaattctgcaaccctgggattcctttctgacactcacctcccaaatccaattaccttctatgaccaaatgctctttgaacattttctaaaactcagcagtctctacatcctctgcgtttgtccttacagtttccatggcctgggaggacctttgttctcctaagacggggccacatactgatcatctgtcaaggacaggctcacacctgccttcctcttcacttcttactgtgacattccctgggactgtactgtatcactctctttcctttattttaaagccaagcatacaattgatactctttgatgtttgcaaaactaataagttattgccctctcatacagaatcctggagtgtgattaattactgtcttctctttacaagggactctacatgaaatatcatggagaatgattatgaatagtcttagtatttcatgtaacttctgtaatattcctagcaattgtgtcttcacagtcaggattgatgaccagtgctgtcaagttcccaaagggtatctaatgctggaatttgcaaatgttcttttggagtgaagaaaattatgttatttaggctgactgaagaatcactaaagaaagaaaattatggtacagtaatatttataaagactcataatcctgtaaaaaacttcctcaccataaccacactttccacagccacatttttagagatttggtgagggtggaatatagtcaaaggtgcttcttaatcatccttgatgaaatcaaccaaaatcaacctacaacattgaaaaaaaaaactagctttgctcagtaatggaatcttatcatccttgacaatgaaaagatattatgtgtttgtgagtgtgaatgtgtgtgtgtgttttcttgtggatactcactcacatagaagtttctcccctggtggcattttatgaggtgctggatcactggcagagctcctaggcacttctaggtaaggatagaaaatagcagacctaacggaatctgcctaagttatagctgataagatagtttatttcaagattttatacattcagaaataaatttgtaaaatcaaaaaatcctttttataaaatgtgcttgctaaaatttgtgaataattaaactaaatgcaatgtgtgaaaagatatgagtctgactaatcaaagggagctctgcaatgtagtattttcagcccagattggcttgatattgtcacactttcatcctgtggcctgtataattctggctcctttcttccatcttatgatgctcattgcaataatgtaacagcaatttcttgtgcaatcaagatgtgtccttttgtctccactggtcaagggtgagtttgaagttccaccctaaatcaacccttccgggaaagcaatagacagggtgtgtgaaagaatgggggctgcaggggttggagtgggggcaaccgtgttcctgacttggactatcctgagctcatcaggtcagaaggtgtgaatccatgggactgtggaatgttggccacttgggggcgctgtggccccactatgctgcagggaaccctggggaggggtgggagggtggccaggaagggagggcggaagggaatgcctggctgcctgctgacatcaggagattaggtggaaattagagtaggtcctggcctgggactgcccagggaaaggtagggccagggttggcaccaagcagggagtgtttctgcctctgcatgggcagaggagggtgtaggggctggggtggcaagggctgggaatcagtgtcaggacagggatagggtgggcagaggaaagtgaggtgtgatgtgggcatgcggggactgtgaccagccacctcccctttagttgaggggctgtgcgggacaggaaggctgcatggagctgctgagcctgagtctttcaatgggtgaacaaggcaggagtggcctgcagaaagagtacctggaaaaggactgtacccgaagaattgggtgacactttcttagctccactcagggagtgaccctgaggagggtgctgccagccagaggggctcaggtcctggtgagctgacaggcttttcctccagacacttcctgttgtttctgtatgtgatctggttttatgctcactgaaatcatgtaaggtaggtatgatttcacctgtttatacatctgaaggaaagcagctgttccgggtctcatattaagtaattggctgaggtgttttcctccaacatctctgcaccagccccgtcccccgactctatatctgtcccttcatctggcttcccctttccaggtccaattagcaggagcacaaggtcatgcctcatatgtgaccattgtaacctcttccctgacaagtccaaggaacacgtgacttccaggccaagcatatccattcacctttcactgaagcaaaacagaaggatgaaattatctgcactgtacacttcctgtaactgatataatctaccttgaggaaaagtaacaagaaaaattgttattcattagttattattttatttaatatatgtttggagatcctttctttgtatagatattttatgacataaaaagcaaaataaaaaagaacaaatgaaaataaaaaagaaaagcttgaaagaataataagtgtttcttactttttagagtattaaggtttgcattaatttttttaacttattcaaagacgtttgctcagtttctgaattatacagatttcctttttttcttctctttttctctttagccacctacagctttttctgccagcttttttagtttaataacctaaggctatcttttaaacagatttttaaatgtacaatatagtatcgtaatctacagacacaaggttggacagcagatctctaaagcttcctgattcttctttactgaaattttgtagccactggcggcagctgcccatttccccctcttcctagcccttggaaatcaccattttcatcttcacttacatcagtttgacttttaggttgcctcatataagcacaatcatgtagtatttgtctttctgtgcctgactttttcaactcagcataatgtcctccaggtttagccacattgtcatgtatggccagaatttcttctttttaatacttaatgatattccattgtatgcatacaccacatttaaggtctgaatattaaatgtatagtatcttattgtttctgcgaaaccatctgtcacaggagtggcagggtcatttgcagaacagtaagcactgagtatatgaatgcacattcattcgaagttcaattctgcttcatagagaagacttcaaaaaaataataatttcactatttattgttattttactatacacaaatagaatttcttttttcttttttttttttttttgatacagagtctcgctttgtcgcctgggctggaatgcagtggtgtgatcttggcccactgcaacctctgcctcccgggttcaagtgattctcctgcctcagcctcccgagtagctgggattacaggtgtgcaccaccatgcctggctgattttttgtatttttagtagagatgagatttcacagtgttagcctggattgtcttgatctcctgacctcgtgatctgcccacctcggcctcccaaagtgctggtattacaggtgtgagccaccgcacccagccaataccccaataccataaaatatttagcatatagtagaaatctagctatttttatttcctttgctagtctcgggcagcctcttccactgcgccaatgcccaaaggcagttaaagacacattttgcctggaaatcttagggtgaggactcaggaagccacagaaatggaaatacatatgcgtgatgattactttgaaagtatgaactagagaatgtagcatatatccctcctcaggcatttaaaactcagtattattgatatataagttatataagcattacacattttaaataaacagatcggttatacgtaaccaaataattaacagaatgaggagctcctgaaaagttttatggttttaaaaggggttgaagccaggtgagctaccagatccacattagggacaattctatctggagatggatattgtgatgaaacaacctcagaaggtcttctaacctggtacagactgattttacgaagtttatttattcattttctttcatttcttttcttatctgctcattcactccaattattttgtaatgatattttggcgaaaattaatcatctttaagggaaatattttgagtttcatcagacacacatgcagctgagctttgtgttcacacactgagtgccctggggccaaacaaaatacggtaatagtgaccttgttgagagatgacgtcacattgggagaaaggttctctttgtgttgacactaagtgtccaattcataaaacctaagccttgagctaggaaatgcccttttctgccctgggaagcaggctcctacattgtgtgtttttctgtctcctggtctagcctggacacagacagtgtacccactcacgaacttgttatatcctggctgtgaatttcagcaccaggtggccctttgctctgacttcaatttctgtgtccttctctcctaaacaccatggatgctgagtgactcagactccagtcatgtgcttttgccaaaaggaaactagcacaagaggaggtgagcagaatatgaaacaaaaccatgtactcaggaccggcaatgtgacttactggcagctctttgctcaaatattgtaaggaagttgaagatcatgacaatgttacagtaacagggatctctttaagtgtggggctctgtgcactaaaatacgggtttttttttttcttttctttttttttttttttttttttgagacggagtcttgctctgttgcccaggctggagtgcagtggtgcaatcttggctcactgcaaccttgcctcctgggttcacgtgattctcctgcctcagcctcctgaagtagctgggattacaggtgcgcaccaccatgaccagctattttttttttttttttttttatttttagtagagacggggtttcaccatgtttgtcagactggtcttgaactcctgacctcatgatccgcccacctcagccttccaatgtgttgggattacaggcgtgatccactgcgcctggcctttttttttttttttttaattgttactgaattagtggtgagaatcctgaccaagggaatattccctatgaaatatgacacttcaaataaaatgagagcgctttttcttatcctggagcctgcctcttctctcctctccccacatccctcacatgtcaagacacctttgtgcccacagatcatgggcagcgttgggctgccactatcatccacacagagagggcagtcagcagcgtgaggtggttctgcctgctgcggtctcaccccaggcacagaaagcaagagccctgggtggagctgaaggtgctcagctgggcttgtcaggagtcccatctgtcggtgaattgaaaagaaacagagcaaaatgactcctccaatggtgatgagcctgcccctgggatttggaaacttggtaacagagaaaaccaatatagacaaaggattttaaacaggattatggtcaattaagcaaattagaaaaggatacttgaagggggatttgggacacaggagtcaaaaacaccgggaagacatgagaagtttccctaagagtctaaattagagaaatatttagataactgacaccagtgtatgaatgaggaattatatcatcacagggataagagttccattgagttacaaactgcttccaaaaaggttaagaaaaactcgtaaggctgtgtcaattcagacaaaggcattcttcccattcaaacggttcaccggtgcatgaatcttgaatttgaccatctggggaaggggcgtggcctctcctgacaggaaggctctggggcccaggcagggagaatgaagtctcagaatgacccccttgagagtcctgttcccctatcaccgatgcacagacccagaagacccctccatcctgtagcacctgccatgagcatcgggctcctgtgctgtgtggccttttctctcctgtgggcaagtaagtcctgggcagggccccatgtgtggatttcaaggcccagcctgtttccattgtggctgcagcatcagctttgttcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaagccacagcgctgcatggccgtctcctctctgcacataaaggcagggaggctctgcctcctccctcaccccagactcagtgatgccctgggcagagttctctgcaccaggaaacttgaaaccccatcatcatgggtctgaggcccccaggatgaaacaggatttgtatttcagatccatctagactctcgtctctccctggggaccatgttgcttcttctctctagggttccccccagcccccaccctcatgttgtctctccctggggaccatgttgcttcttctctctagggtttcccccagcccccaccctcatgttgtctctcctgtggcccacctttcccatctgggcagtcaccctccaaggccttgctgggtctctcctcccctcacttccccacacctctccacagcagccatgaggggagcccctcttctgtgcctccttccttcccatcacagagacttcaaagtccattttctctgccctgggctggaggcttcctttctgcagtggccaactcctacctgtgcttcacatctcagcatgatcagccctcctgtgggaagcatgcccttgcctcccagctgagatcaatttttctgttataagcactgatggtaaaatgtgcttgttagtcaacagagttgagcacagttggagttttccagttacttgtctggatatttttctgctcatgtcgattttaaactccataaaggggaaggctgtgcttgttacatttaccaacagctgttcctggaatgaagggagacctgtttcacagataatggatgagttaatgaatgacaggctgattgagtgatgagcgggtggatgaaccaataacaggaacactccaggtccgctgtaccctggcagaaatctagagttaactgtgcctgagatgctctgctatgagctcttcaaagggcactcgcttgttgaacaagcgttggaccattcattgtgcaagccagtttgtcagttcatctaggagtttccaattttaaatatcatatgttcttcaaactcaatgagggtaaagtctacattatacaattctaagttattttttaaagttttgggttaggaaccaaaaaggaaagaagagggaatatctttagactttggagtttttttattgaaaatgtatttatataaatttttcttggaagaacaggtagggaaagtcatgactacacagccttataggtgctaatttctggagaaggtgtcatgaaaaataacaaaaatgagaactgtgttctggagggaacattgtgactgtcctgagagcgtgttctgatcccaggaaccaaacccaggagtgtgtttggcaactcagagtgcagcagacaattctttgccccgtgcatttgggataagactggagacagctggaaaagctatggactggacgttctgcactctcaatgcaggactctctgaaatcccacagattaatgtcaggtaaatatattcccactattaagacaactaaagcaagaaccaatgaagaaaagtgagtagaaacagtaagcaattgaaatgtatgaagacaaggaattttgccataaaaagatataaaagttaaagagctatatttaaaggaatacaaaagcgaattgatatgtgaacatgaaaaagaagactgtcagaaataatcaaggaaacattaaaaaataatcaaagagaatacactaacgattaagattatcattgaaaacaaaatggaaatgaagaaaagatgacatgcttcaaaagagattgttacaggaggtcaaagacagatctgaagaagttacctagaatgcagcacagaaaattaaacaggaaacaagaaaaggtaagggataaggaataaaacacttgtgggttctagtgtattagtgtatatataatattttgttggaacttcccatttttcttacacatgattgaagtgtcacaaagagaaagtagagagaatgataggtgataattatgagacattagctgagaattttcaagacgtgtttcaggacctaaatcctctgtttcaacaagttaaatgaatatgaagtagatgaatacatatgttatggtgaaattgcggaacacaaatgacaaagagaagattttaaaagtagcccaaaagataactatctcccagcagaatagactgaaaggaacagtgaaagtcaagaaaggagattaaaaataagcatcaagtcagaattataattctcattcattaaatattgagattgaggtaaatatatttatagatagagaaagaaaaaacacggtgagtttgtcaccaaggtatcctttctgaattatagttaacaaagatgggaagtggtcccagaagaggggcatgaggtgccgctcgtgagggaacccatgtgatgggacagccccattgggcacgtgtgactggggggatggaggaggctggggcatcaatggggatggcacaggggactctgacttgcaggaaagacaatgagctcaccttttggtgctttgtgttggcggagctgttgacacatcctagagaacatgcccagcagacagaggagcggctgtgggatgaggagataaactcagagatgcagcgtgaggcctccgggtccagacagcatgagagcccaaagcgatgatacatgcattgatgttgttaaaaaggattttttttttttttttgagacagattctcgctctgtcgcccaggctggagtacagtggcgcaatctcggctcactgcaagctccgcctcccgggttcaagccattctcctgcctcagcctcccaagtagcttggactagaggcgcccgccacaacgcctggctcattttttgtatttttagaagagacagagtttcaccatattagccaggatggtctcgatctcctgacctcatgatccacctgcctccgcctcccaaagtgctgggctcacgcctgtaatcccagcactttgggagaccaaggtgggcggatcacttgaggtcaggagtttgagaccagccggggcaatgtggtgaaaccccgtctctactaaaaatacaaaaattagcctggtatggtggtgtgagtctgtaatcccagctactcaggaggctgaggcaggagaatcacttgaacttgggaggcagagtttgcagtgagccgagatcacactgctgcactccattctgggcaatggagcaaggctctgtctcaaagaacaaacaagcaaaaagcaaggaactcataaatatttaaaggagtcatttaagtaggtcctaaaataaatcctttgttcctgtcattgcgtggattgagagaggatgtgatgtcactatgggaccttctgtgtgggaacaaggacatccctcctcctctgctcctactcacagtgactctgatctggtaaagctcccatcctgccctgaccctgccatgggcacaaggctcctctgctgggcagccatatgtctcctgggggcaggtgattcctcagatgccaagcagtctcctgtgtgtgtgtgtgtgtgtgtgtgtatgtgtgtgagatgtgtgtgtgagagagagagagagagagctgactatagttgtttttctcattcagttcccaatttctgtctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagctcagccacagcactactgctccagtgtcagcttggttccctaggaaatggggtttctagaacctgaatgctgacaaataagagttgtatatgtgtataccatgcaacctgcgtttaaaaatgtatgtacatagtgcaatgactaaatctagctagttaacatatgcagtacctcaatccttatcctttccagtggtgagaatacttaaaatgtactctgttagcattttcccagaatacaaaccactgttgctaactctagtcatttgttgtataatagatctttgtaacatcttcgtcttatctgagtgagattttgtatctgttgaccaacatcttcccaacagtccatctctactccagcctttgctaattactgctctagtctttgaatttgaagtaatttccctgaggtctttagctcaacaagatgggggaattttctctataatgatgcttacgttatttttgctttgtttttgtttcgttattttatgtcttgcaatatagtgtttattgtaaatataaataagtatattgtaataaaaatccttcacctctctttgggtaaagctacagttcacatattctaaatttcatgctgtgaccaacgctgacataattatggatcatgggtttctgggagtcctcagagacagccccatacaccaagtttaagatagaatattccagacccagccaggacagaagtgcatggtcctgcatagctccttggaaaattatagttccccaaattcagttattggatattgtggtgccgcagacaccaaacgtctttctctagcaaatgatggtccttggcagggattgttctgaacccattacaattttgccatcatcaaatcactccttgctgttaccttgtgtctcctgggagtgaggacgccccgggcacagatggaaattccctgaccttcggatgctatttcaaggacttcctaagaccttgtgtccatctttttccacctttatccacatgactcctgagacccacgctcacaatagtggaccagctctgattcttaggcttgaacagaattcagaccacagctgtaaacactgttgctgaaaaaagatgtaaaaaaggtgggcagggcttcctacctacactgagggtgaacatacaagggcataaagggaatattttattaatagctaaaaaaagaagaaatacaagccctgctctaatgaaatgagaactgtagcttcacccacagagaggtggaagattttattacaatatacttatttatattcataacaaataatatatttgaaaaaataaagaaaacaaaaagtaatataagcattattataaagaaaatacccctgtcttcttgagttaaagacctcagggaaattaagacacatcaaaagactagagcagtaattaccagaggctggggtggagatggggtgctggggagatgctggtcaaaggatacaaaatttcactcagataggaggaagaagtttaaaaaatcttttatacaacaaagtgactagagttaataacactggactacattctgggaacatgctaacagagttgaattttttagttgaaccaaagcagaatgtccataaaattattttgaatcaaagtctagaagctttcaaaccagttggcatagccttgtgttctgtgatctcagcagcttcagaggacttggcaatcctttctctgcacaaacacccctttgtccactctaagaactagggacacacactcttatcctatcacgaaaacaacaggctgtgctacagttgctggtaactcgttttaagggtgttgagtatggaggattgaacaagattgaaagctatgctcctgagtctgggaatgtgctggaaccagcttgcatgattcagaagagccaaataggcaaacccttcccaaatcctcattgaatgaagccatgatgacagcttgaaatctgccatagtggctatgctgataccataggaactgacaaatgctactaggcatggccccaccctcacagatatccagtttacaaggacatcactggaatgttttctgatacaatgatgatcctattagggcatgtcttatggggccaaaaaggctcagaatccactgtccatctgtttctgctcctagaagccatagtctaagggaatctcaagtgatcctacttctctccaatctccaaattcccttgctctgtgggtctgtgtctcttatgagcatgccaatctgaaacaagacaactatttggaatgtagctaaaggaaacagggaaccagtccattattttcaaattatccttccttgcatgaagtatgcagatgctgcaatcactgaaaacagagatggggcaagcagcagctctgggctgtgagtcactttatactatagtgccccgctattcctctgtggcactgacagaccctgcagcatggactaatttgcataggaaactaagcagcccctgaccatcaggtatgaccctggattcattttgggctgagaggtcagaaggatcatactcaccttaaatattatcctctccaagctgcaatactcccactgtccatcttagtcccaggatgttgtccagagctccagagaatcccttctcttggggcagaatcaccaagcttgctccctccagatttccacagtctccagtgggtatggggcacaggtgccattctgtgtctcaggtagagagaggcatcatgtcaaatgatatttgtagaagagggattcaaattctgaggctcctctccaatatttgacataattttctttgcttcttgtttcattctacaatctcacaatttaggagagtaattcttttgcggttgcattgttgacagcatttgggaaagtttttgtggttaaattaatttaaacaatcattttaatggtgtatttcttctgttcacgatagaacagtgaaagcagtcatttacacatcctgttgatgaaggtgttgtttaaggttcatgatccacacctaactctcaatctagttgaaatgaaaaggtgcagaattaggtggcacgtgagcaagctatgagagaggctcatgccaattactgtgggatttggagggagggagagatgacctctgctctagaccatgctccacgaagaaggagtgggagtttgtccatgggagactgcagaggaataaataccagcagcttctaactggggtggagtgagggctgcgggagcaaatccttggaacagaaaatggtgcatttgagctctcacagaggacagtggaaagaaaagtcatataggccacagtcccccggcaggttctgtttgctaatgatactattttgcaccagtgtgtccttatctcacaccactcctctgcctcttccagaataatctcttccctctccgctgctcagatcagcagatgtgccttgtgcaagttactcatttcacatagcaggccttttgctggtcttaattatatccgtcgttactttccacattagatactgtgtattgccttgcaaatgatcctactttttatattcctatttttcacttgttaatgcatatttgaccccttcttgaaggtcaagatgaccttggaaatataaggctatctcattatctggtcagtcttttactaatctttatttttatcgtaacattgactgtcattttgggggacatgtttgtttatcttgaatttcattgagtttcctcaaagcacgattttgagttctttgtcttaaaggtcgcatatctctgtctgtctagggttggtccctgttttattttttttttgagaaattaccgacttcaccagatgctgtaagctaccgggatagaggaagtttttgtgatttcatagcttgggtcttctttattcagggcagggaattttattttggggtcaagattgttgaaaatggcatagtgaagaaggtagagtcacaggagtttgctttatatacttgaggaagaagaaactgagatttgggaaaagtcaagaaaagagaacctgatcaaagatgactgaaaatagtaatagagcagaaaatgatgaaaagtcgtgttctgtgcaccacgaacgttcttctccccactccaaaagttttcgacacctagaaaatataaagaaaggactgatagcaactggcatcacgttgaggccagtctcagttgggaaaaacaccaaacagccgcttgtctcctgtaagaaccctgaagttggtcctgatgtcttctttctggactctggccctgatcttaactcctcagggaagtcaggtacttcccaaaatacagagaatgtcagattgcccttggttttgaaggagaaaatgctctgtgcttctccccaagataaattctgctttcctaggaatgctttctaacactcgtcatccagatctgattaccttctgtgaccaaacggtttccgaagattttgtaaaactcagcagcctttcacatcctctgcgtttgcactcactgtttccatggcccagaaggacatttattttcccacgacagggccagacactgctcatctgccaaggacgggctccctcccacctgtcttcctcttcacttctcatcccagcattctctggcactctatgatatcactctcttcactccacaggccaaaccaagaatataattggaactgcctgatgtttataacatgaatcaattcaagtccacttacatagacccctggaatacatgaattactatctcctctttacaagagacttctactacatgaaacatactggagagtctttagggataggctcagttttctacacaaattctgcaatatcctaaacaattctgtcttcacagtcataattgatgacttgttctctaaagtacccgaactgtgtttaaagtcagaatttgcaaatgttcttctgagaaaaaagaaaatcattacatcttagtgacatttatccagtctcacaatcttgctgaaaaatatttgtcatcataaccacactttccatgaccacatctttagatatttggtgagactggaaacatcaacaatggtccttctcagaaatcaacttaaaacactgaaagaaaaagtagctgtgctcagtaattgaacctcatcagccttgccaattaaaacacgttgtgtgcatgtgcttgtgagtgtgagtatgttttcttgtggagatgcaaatagtttctgtgggtggcatttactaagcatcactggatcactggtggagttcataggcactttcctaaccccagggagtgatgggaaatgtcacagccactgaatcggcctaagttatagctgatagggttgtttattttaaaattttacaaattcagaaataaatttgtaaactcaaaaaatggggccgggtgcagtggctcatgcctgtaatcctagcactttaggaggctgagggaggtggatcacgaggtcaggagtttgagaccagcctggccaacatggtgaaaccccatctctgccaaaaatacaaaaatttagctaggcgtggtggtgcacccctgtaatcccagctactcgggaggctgtggcaggagaatcacttgaacctgggaggtggaggttgcactgagccgagatcgcaccactgcactccagcctgcgtgatagagcgaagctccgtctcaaaaaaaaaaaaaaagaaaatcaggaaatcctctcttataaaacacatgatgtaaaatttactgatattaatttaaatacaaaataggaaaagattgggcctgattaagcaaagggagccagggaacaatgcagtgtttctgggctaggtgggcttgacatcctcacactgtttaattaagggtctgtgtaattttggctgctctctaagtgcaacaacggtttattttgtaataaaaagattggttcatgtgtccttttgcctcacttggcccagggtgaatttgaagatcaaccctaaattggccttttggggaaagcatagagggtgtgaggatgagggttgcaagggtgggagtggggcatctttgttcctgatttggacaatcttgaactcatcaggtcaggtgtgaatccatgagactgtggaatgttggccacttggtgacgctgtggctccacaatgctgcagggaaccctggagaggggtgggaaggtggccaagagaggagctgaagcctatgcttggctgcctgctggcttcaggggagtggtttgattcagagtggatccagagttaaacacaaactccccactaccagagaagagtagaggtgctggaggcctcagtttgcaccaaagagtagagtgtccctgtgtctgcttgggcagtggatggtgaaggagcttcagccacaagggctgggaatcagtgtcagggcagggacagggcaggtagaggaaagtaaggtgtgatgtgggcatgtggggcctgctctccacccaccaaacctttagtttcagggctgtgcgggacagatgcatggagcagctgagcctgggacctgccaaagcgtgcaaggggcagtggtggcctgcagggagagaaactcgcaaaggccagttcccgcaggaagctccagaaacattcctgcccccactcaggaagtgaccgtgagagacatgctgtcagccagaagggttcaggccctggagagctgataggcttttcccaggcactttctgctgcttctacatgtgatctgctttaatattcacataaattatgcaggataagtattattttacctgtttatgtatctgaaggaaatcagctgtccggggtctcatacttaataactggctgaagactgggtgcagtggctcacacctgtgaccctagcactttgggaggccaaggtgggcaaatctcctgagctcaggagttcgagaccagcctgggaaaatcggtgaaaccctatctctactaaaaatataaaaatttggccaggtgtggtggtgcacacctgtaatcccagctactcaggtggccgatgcaggagaatcgcttgaaccctggaggcagaggttgcagtgagccgagatcatgccattgcactccatcctgagcaacagagtgagactctgtctcaaaataaaacaaaataaaataaaataaaataaaataaaataaaataaaataaaagtctcaagcctgttgtgccaacacctctccttaaccccttctttgtagctctatcctttcacctgctttcccctttacaggtccccatcaacaggttgtgaagttcatgcctcatacgtaatcagtatagtctcttccctgagaagtccaaggaacatgtgacttccaggccaagcatatacattcatccttcattgagacaaaaaaaaaagtgtaattttctggccagccatgatgcttcacagctgtaatcccagcactttgggaggctgaggaggtgaattgtttgagcccaggagttcgagaccagcctgccaacatggagaaaccacgtctctactaaaaataaaataaatcagccaggcatactggtgggtgcctgtaatcccagctactcaggaggctgaggaatgggaattgtttgaactcaggaggtggaggttgcagtgagctgagattgtgccattgcaatccaggctggacaacagagctagactcccgaaagaaggaaagaaagaaagagagagagagaggaaggaaggaaggaaggaaggaaggaaggaaggaagaaaagaaaaagaaaaagaaaaaaaaaggggtggtaattttctgaactgtagacttcctgtaacggatgcaacatatcttgagaaaaaggaacactagtaattgttattcactagttaatttattttattcttttattcaataaacttttttgggggacctactgtgtataagataccctatgtcgtcaaatagaaaatgaaaaagaaaagtatctgcagatgatggcagattttaaaaaataaaaaaagaaaataaataaagaaagaaagaatattttaaaataaaaaatattttttggctatttataacactaaggtctgcatttattttcatttttcaattgttttatgtttattttcaattgttttatgtttagtgtacttagtttttgaatttatatatttcctttcttcttctcattctctctttggtttctccttctctcttctttgccagcttgtatttcttttttatttaaacttttggtaaggacatttaacatgagacctatcctctgaacagatttttaagtgtacaaaacagtatcatagtctacaggcacaaggttgtacagaagatctctaaaacttcctcatcctgcttaactgaaattttatacctgttgacagcaactccgcattttccccaactcccagctcttggaaagaaacattctcatctttgcttccatgagtttgacatggttgcctcatataaacagaaacatgcagtgtttgcgtttctgtgcttgacttgttcacttagaacaatgtcctccaggttcatctatgacacatatggaaggattgtttttcttttctaacccttaataatattccatgtttcagatctgcaggattaaatggatataacatttggctatttctatgaaactctctgtcatgtgagtggcagagtcatttgcagagctgcgagcactgagtttattcaggcacattcacagataaattctgctccatggagaacattcagaaaaaaataataatgccaacttttatttgtcaattcactatatgccaaataaaaatctttcatttgaaaaagttcaattaattagaaattcagctatcagaaaaaaaccttaagatgcaaatgctattctcattttacagatgagggaattggctcataggttaaaaaacttgaccaaattgaagagctattaggatacagtattgggacttcaacctgatctgtccaatttttgcatttataactctgtgctatagtgcatttcatagagagagatgcctaccttcaaaaatcagaatattggatcctacatccctttcagatcaactggctctaacaacatggaaagagatcagtttaccctggagacagtgatgtaaggagagatctctggctagatgccatgacactcagccctgactcccattctaacaccaacttgtaaagacctgaggccattcttgacatgctgcgtttagtttgtgttttgggtttttatttttttctgtaaaatgagatgactactgcccttatgaagagttgtacaaagatttaatatgacaaagtatctagcatatagtagattctagctattttgatttcctttgctaatctcaaacagcctcttccactgtgccaatgagcaaagacaaatatgaacacattctgcccaggaatcttaggttgaggactcagaactcacagaagtggaaatatatatgcttgatgattcatttgatgaaattacctgcagaacatagcgtacatgccttctcagacattttaaaatcagcacaattgatatataaattgtacaatataaacattacacatgttaaataaacagatcaatggttttatatatatatatatatatatatatagacatatatatgggttataaggatatatatgtatatccttataaccactatccctataaaaaggtctctatcacccagaaatctctctcatacccctttgccatgactctctccatctctgacaaccaatgatgtgatttctatcactggagaatacatttttttcaaaaaatctattagtaacattttaaaacctgtattgattaatccttttcaaatacatacatttaagagtgcaaggtgctcctcgaaagttttatggttttaaaagaggctaaatttctgtgagctacctgatccatgttagggacaatcctatctggagataggtaagaggatgaaatagcctcaaaattactttccagctggtggaagctcattctccaaaattatttattcatttttatttatttcttttatcatctacccactcattcaaattatttattttataatggtattgtgacaacaattaatcattttaatggaattattttgagttcccatatcacacatatttaattggccttcaagttcacacactgaatgcaacggcaccaaacaaaccatggtaacagtgactttgttgagagatggtgtcatatgtggaaaagggttctctttgcttttaccgcaagtatccaacccataaaacctgaactttgagctaggaaatctccctttttgttctggccctaccctgggcaccaggctccagcaccatgtctccttctgggttctggcccagagaagttcttggcacagttgtagcacccactcatgggcttgctggatcccagctgtgaatgacagtagcagggccccctttgctctgactttaatttctgtgtccttctcaaataagccctatagatgctgagtggcctgggcccctgccatgtgcttgggctgaaagaaagacagcacgtggggaggtgagcaggagcgaagttgaagcaaatctagaattgacatggaaaggactttggacataaatccctaggcagtggtgagccactggtcctactccaagtgaaacaacatgatgaaactgatattgtgttacagtaacattggtagtagtacggatctgaaaggagatagatttttgggtggcatgaatgattaggagacttctaaatatcctccatgaaagattagaaagggtttatgtaaagcattgtggaagacataggcttgaggctctggattatgttatctcttggaaagagtgttgggttttattctggaagggttaaatgtaggacttgctaggttctatttgagctttgcccttcctcttagggagccccagcctgtggtcatcattgctagtgcatggccttcccagggtcttagtgggaatcacagtgtattcgccacatcactccactgcaactgggtctgaatgccctggctcttctgaaatctctgcccatgtcttcagccttccagaacttgttctctgctcagccttctggtctgccaccctctgcatacacaatttaggatctggctcaggaaaaaaaaaaggggggtttcttacatataatttttgggttcctttttactaccctgtgtcttaaatcccagctgtcttggagtcagttatgtcctatcttcaatcacataaactaacgatatttggtacagacatgtttactgactttacttcacgttaccattccactcttcactcttctttcttgcaattcagacagtcctgaggtcattctccttcttcagatccatctggaattcagatgacttcaactcacctgtcacccaccctatgctttgagacatgtttatgttagctactgacctcagggtagtcaagcctctcattgtcattgttattcaaggtaggttgaatcccactaaaaaacaaaaatccttgaaatttggtttccttattgagagccacacaatgcaatcaaattctttttaattcaatttttttttcttttttggtggaagggccaagaactgtttccttgctgaagcagactcctattataataatttgaatactaacaacattaacctttaaatcaggttgatgttaggttcttatctaagaatgaagtatatccaactgtagcaggttgaaggtctctcatatatgtaacctgttcaggacgagacaattcaaccacttttcttaaattctgatctacatgcctttacattctttgctttaagggccacataaaaatactctgaaacaatttacacatcagaaaaatgctaacactttcctcctggcccagcacatctccaagttaaaaaaatctctaaattatcaacccatagtttaatcatggtaactcccttctacccccaacatagatttttatgtaactgatttgtaactacaaccttaaccgtacaatcacaattgtcattataaaatactaacaaacatgtgctattaacaatggatggttaaaatcacttagggattatgaatcatttcatttttgtgtttatttattatgtcagtttcaacctgatttccctttcccttgttccacacaccttgggttgttctttttcagcatcctgtgtatgttagctctaagcccagccaaggctcatgtccctccacttcagggacagagggtggctcatccctttcgtgctccctcagctccctccccggtgcctggttgctggttggcatcacagccatgcccttgaaagatgggcgctggtccacactgcatccgtggtcatgtagccaccctccctccacagaaccgagcaaaaagggctccaccgcgcttaggcattgagggaatggacattttgaatggtgctgtcttgtgtgatccctcagaggagaaggagatttcttgaatgggagtggtctgttgctgagagggatcctgaaagacacggggacagagacaggggtaggatccacataatgaggaagcagctgagaacaaaggagcccctgccagaggaatatccttggggggtaaaaagctggctctgccctttctccccagcccattcatcccagcccagacaattcaaatctgccttctatcaggacctagaaaggatgtaaaacggccgggtataaatatcccctgggtctggggaaactgtcaggagcagtgacatcacaggaaaaaccaccaaccaaggccaaggagaccagagcccagcacctcacccagaggaccccagtcagaggccccatctcagacccgaggctagcatgggctgcaggctgctctgctgtgcggttctctgtctcctgggagcgggtgagttgggttcacatcagctgtccttgaattcgaaactttttccttgtgatttcagcaacaagcctcctcctgggctctgcctgaattttgtccctttccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagccaagacacagccttgcagagtcaccgctttcctgtgtagaaaccttaggggccctccaggaagctttgggggccaccaaagccttcgatgaacatttcctacaagagccccgacagaagattcagaacatcatagcacctttaatggcataaaatatctagcatatagtagaagcctagctattttgatttcctttgctgatctcagacaacctcttccaccacaccaatgtgcaaagacagatatggacacattctgccaagaaatcttaggttgaggactcagaagtcacagaaatggaaatatatatgcctgataattcatctgataaaattaactagaggatgtagcatacatatctcctcaggcatttaaaaatcaacattattgatctttaaagtatatgaagttaacaggacaccttttaaatgaacatatctgtgatttttgagcaacatatatctatatatgcaaccccacctctatgaagatgtatctgcatcacccagaaagtccctcactcccctctgcaatgcctctgtctgtcccagcaaccaatgatgtgacttctatcactggagagtcgttttgttggcaaatatttttaatgcaaatgtcaaacctcttctgaataatcctcttgaatacatagctaaatcatcaaggcagggaggagttcctggaggttttatggttttagaagtggttgaagccaggtgagctacctgacccatggtagggacaattctatctggagatggatattgtgccaaaataacctcaaaaggtcttttcggctggtagaagctgattctacaaaatttattcattttcattcgtttattttctcgtcaattcattcaatcaaacaattttatgttacgttttgacaaaagttaatcatctttaaggaaattattttgagttcccatcagacacacaagcagctgggctttgtgttcacacagtgagcatgctggggtcaagcaaaccatgatcacagtgacttcattgacagatgatgtcttattgggagaagggttctctttgacttgaccccatgtgtccaacccataaaacctgagccttaggctaaaatccatcttccttttctcaccctgccttgggcaccaggccactgtgctgtgtgtttctctgtctcctgaagcagagtcctgggcgcagatttggaacctattcgtgggcttgtttgatcccagctgtgactttcagtaccagggggtcctttgctgtgacttgaatttgtgttttctttactcttaagttccacagatgctgagtgacccagaccctggtcatgctcttgtgctgaaaggaaaccagcacatggggaggtgagcagtatatgaaacaaaatcatgtatttacaaccagtggcaagacttactggcaggtgctttgttcaaacactgttaggaatttgaagatcatggcagtagaatgtgaaaccaagtgcagggtccttccaaatgcaggcctctgtgcaccaaagatagacttttggagctcattttttttaaacaaaaacggaaacaacactctatgttcatggctgtaggccatgcgagaatatttttttaaattttaatttaatttttatttttccatatattattggggtacaggtggtatttggttatatgagtaagtttttagtgatgacttgcaagactttggtgaacccaccagctgagcagtatacactgcaccatatttgtagtctgttatccctcaccccctcctgctgtttccccaacacttccccaaagtccgttgtatcattcttatgcctttgtgacctcatagcttcgctcccaaatatcggtgagaacatgctatgtttggttttacatttctgagttacttcacttagaataatagtctcccatctcatccaggtagatcattccaaatgctgtttattcattcctttttatggctgtgtagtatttcatcatacatatatgatatatatatgatatatatgatatatatgtgatatatatgatatatatcatatatatgatatgtatatgatatatatcatatatatgatatatagatgatatatatatcatatatatgatatatagatgatatatagatgatatatatatcatatatatgacatatatatgatatatatatatcacagtttctttatccactcgttgattgatgggcatttgggttggttcctttttctttatcactaaattaatggcagcaataaatccagaacattcctcattaccctaaagtcagccctgtctcccaaactcccttacacatcaggacacctttgtgcccatagatcatgggcagtgcttggcagccaccactgtccacacagagagggtagtcagtagcgttaggtggttctgcttgctggggtctcaccccaggcacagaaagcaggagccctgggtggagctgaaagtgctcatctgggtttgtcaggagtcccatctgtcagtgaattcacaagaaacagaacaaaacaactccttcaatgttgatgagactgcccctgggatttggaaagctaataacagagaaaaccaatatagacaaaggattttaaacaggactatcggattatgatcaattaagcaaattagaaaaggatacttgaaggagtatttgggacacaggaatcaaaaacaccaggaagacatgaggagtttttccaagattgtagactatagcaatacttagataaccaataccagtgtattaatgagtaattattagtattattattttgagatggagtcgcactctgtcatcaaggctagaatgcagtggcatgatctcggcttactgcaacctccgcctccctggttcaagaattctggtgcctccgtctcccgagtagctgggactataggtgcacgtcaggatgcctggataatttctatatttttagtacaggtgggatttcaccatgttggtcaggctggtctccaactcctggcctgaagtgatctgctctcttcagcctcccaaagggctaggattacaggcatgggccactatgcacagccaagtaatttgtatcatcatgggaataaaaaatatacattgagttacaaactaattaccaaaagatatttaaaaaatggtagacttgcatcgattcagacaaaggcattcttcccatccaaactgttcactggtgcattgatcttgaatttgaccatctggggaaggggcgtggcctctcctgacagcaaggctctggggcccaggcagggagaatgaggtctcagaatgacgcccttgaaagacgtgttcccttttcaccaatgcacagacccagaggacccctccatcctgcagttcctgccatgagcctcgggctcctgtgctgtggggccttttctctcctgtgggcaggtgggtcctgggcggggccccttgtgtggatttcaaggcccatcccctttccactggagcagtagcatcagctttgtccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttactccacagtgctgcacggctgtctcctctctgcacagaaaggcaagggaaggtgctgccctcctccgcagcacagattcagcgatgcccttggtcctagcaccgaaaactttggagccccaatgggcccgggcggtgcgagccttcatctgtgccaggtgcctctgcagtcggtctcggccaggcctggatcggtcccaggacctcagatgtcttccttgttgccctccggtctttcctctgaggtgtccttttgggctagtgccaggggtttcccagctctgactttcctagtcattcacctgagtctgaggcctcctaggtgaaataggatttgtatttcagatccatctagactcccgtctctacctgggtaccacgtgctttcctctctctatgatttttcctcatgttgaaccctacggtggtctcagctgcagcctgcatttcctatattcacagtcgccctccaaggccttgctgggtttctcctccccgacctccctgcccttctctactccagccatgttgagagactccaaagtccatttcctgtgccctgggctggagccttcctttctgtagtggtcaacacctacctgtgcttcagatctcagcatcatcagccctagtgataatcaccattatgcttcccttggctcccagctgaggtcagtttccctctcataatctctcatggtatcatgtgtctgttaatcagtagaatttagcacagttggaatcttccaagtactttaaaccccatgaaggccaaggctatgcctgggttataaatcagcagctgagcctggcacaaggggagatgcatttcagagaatggatgagtcagtgatggagtgagtgatgagtggatggatgaatccataacaggagcaccctagatccattttacccttgcggagatctggctgtaagtacaagaactcttacccttttgattgctgggctacgggaggtccttgaaattaatggggagtcgctatcatgggcggccccaccttggtcaaagattcctcctgagtctgcagcaccagacctcctccaggtctctgtgctctccttcagactctttcccacaacaactctacacagatcagagatccctttccagaaacccatgcatagagttgtgttattttggaaccacttctggtaccaaaaactccattaggtttacatcaataaaacagaatcactaaaagtactatggagaggaggatttatgacaggagttagaccttatataaatgtagggggagctgaggaagagaaggtctggaggggagatatagctaggcagatttaattcatgattaatgtgaccgtgacctcttattctactcaaaggagagcatatgatttcaacaaaaaaatattgattttcctttgtaaaagtttgatccaaatagtgagctatttttgtcccataattgtcttaagttggctaatggtggaacaaatccgactttgatttccttgaaagaacaggaaaaaaaccgtcattcatatacagtcttacaggctctattttatggaggaagcataataaataggaaagagaaaatcagaattctcttctggaacctacattgggactgtcctcagagcaggttgtgatgtgaggaatcaaatctacaggggtatttcgcagcttggagcgcagcagactgttcccgaccccatgcatttgggggtgagaccagagacagttgaaaaactatggaatcttgacattctgcactctcaagcctggcctctccctgaatttcacagattaacatcagaccaatttattccgactattaaaagtattagaacaaaaaccaaggaggaccagtgagcagaagcaataaaccattaaaatggacatcctaaagatttaaaattttgccatcataagatgtgaacgtttgaagagctgcatttaaatgaatacaagaagggactgaaacaagaatacacacaaaaaagagacggcccgaaaccatcaaaaaacattaaagaaataatcaaatagaatgtctagaaatcattacgattactccacaaaacaaaatggaagctaaacagcagattcaatgcttctaaagagattgttagcaatatcaaaggaggatctcaagaaatcacctagaatgcagcacagaaaattaaatgtaaaatataaaaaaagtgaaggaacaaggaaaaaatgaagtttctagaatattagaaagcatataatgttttattgaaacttttcttactttcttgtatataactgacgtttcagaaagagaaaataaggcaaatgatctgaggtgattgtgtatgtgatgctagctgagaatgttcctgagatgtttgaggaccgaaatcctcgttcaagaattcagatgaattgcaagacaagtaggcaggtccctgtgaaactgcagaccataaatgacaaagagaagattttaacagcagtcaaaagggaaagataaataacttccagtggaatagaatgaaagaaataatcaaagtcaagaaagaggattaaaaataaccattcaataagaattgtagtcctcatttattgaagattgagattgatttaaaaaaatctataggacaggaaagaaaatatggaaaaccaaaagaattctgtgagtttgccaccaaggtatgttttctgaattatagttaacatgggtgggaaatgatcccagaagaaaggcatgagggcagtttgtgggggaacccatgtgatgggacaatcccattgggcacgtgtgagtgtgggaatggaggaggctggggcatgaatgggtatggcagagggcaccctgacttgcaggaaagacaatgagctcactccttggtgcctggtgttgggggcactgttggtgcatcctacagtacgtacccagcagacagaggagcgtctctgggatgagaaggtgaacttggagatgcagtgaggcctctgggtccagacagcataggtcaaaaaaagagaacctgatcaaagatgactgaaaatagaaatagagcaaaaaatgatatatgtgcctgatgattcatttgatgaaattaactagagaacatagtgtacatgcctccacagacattttaaaatcagcattatttatctataaattatacaatataaacattacacatgttaaataaacaaatcagtgagctatatatatatatatatatatatatatatatatatatatagagagagagagagagagagagagagacatatatatatgggttataaggttatatatgtatatccttataaccactatccctatacaaatgtctctatcacccagaaagttctctcacaccccttggcaatgactgtttccatctctgacaaccaaatgatatgatttctatcactggagaatacatttttctcaaaaaatctattagtaacattttaaaacctgtatcgactaatccttttttaatacatacatttaagagtgcaaggtggtcctggaaagttttatggtttaaaagtaaagttctgtgagctacctgatccatgttagggacaatcctatctggagatagataagatgatgaaatagcctccaaattactctccagctggtggaagctcattctccaaaattatttattcatttttattgatttctttactcatttactcactcattcaaattatttattttataatgatattgtgacaacaattcatcattttaatgaaattattttgagttcccatctgacacatacttaactggccttcaggttcacacactgaatgcaatgggactaaacaaaccatggtaatagtgactttgttaagagatgatgtcacatgtggaaaagggttctatttgcttttaccccaagtatccaacccataaaacctgagctttgagctagaaaatctccctttttgttctggccctaccctgggcaccaggctcctgcaccatgtctccttctgggttctggcccagagaagttcttggcacagttgtagcacccactcatgggcttgctggatcccagctgtgagtgacagtagcaggcccccctttgctctgactttaatttctgtgtccttctcaaataagccctatagatgctgagtggcctggacccctgccatgtgcttgggctgaaagaaaaacagcacctggggaggtgagcgggagcaaagttgaaggaaatctagaattgacagtggaaggaggagatgaggaatatcaattatggcattaagtaccagtgatagtagcaggactgtatcttatttccttaaacctctgatacttgtacagatagcagctgaccacaaccttgaagacctatttggactcaatggaaataatgcatgagtggactgtatcagttgcctctattaccacctcatactctcttggttccacctttgattccagccacagctatgatgaacagttctatgcagacactgacctgctccacagttaccgcacctcaccttcaatgtggccacgtgttcccaaaacacgctgttgctgaggcatgagacacattggtggtctgcatggcgcttgttcatgcacaatgaagtgtgagtgagttaatgtcctatggggcaattctcaaccactggagaatgagaactggtggataaaagccttggcattagtctcaggctcctagaaaggcctagtttgatagccagccacctatctatagagatggcccgattaatatgttttcctttgtattttctctgctttttgtttctctgattcagtatggatattttcacctgacctatcttccagtttatctagtcttttcagctttatctatccttctttaaaatatatatatatatatttttttttcctaaattttatgtatttcatatatttcagttctggaatttccacttcaatcttgactacagtattcagttgtctgctaaaattctccattttgtcatttcctttttgattatattaacatcagttattttaaaggcagtgtctgataacacatctctgttggtgtctatttcttttgtccgctttcttttttttaatttttggtcatgcaatgttgttttctcacacaatcaacaattcatttgaatgctaggtattgcatataaaaattacagagataatgaggctctgaatgatttcatcttcctcagaaaggattcatgtttgcttctgctggaaattgtagcagagacaggtcaccttaattgagttgatgactgagctggatcagagctgggattcagccttcctgatggcttctcaactttgctattagccattaaacttccaactagatttctggagtattttaccagcttattaaagtgtaaattacataacataatatttgcctactggaagtgtgtaatttaatgagttttgataaatttgtggagttgtgcaacaatcaccatgatctagctctaaaatatttcatcctccctacccagaaagttccttcgtgctcattttcagtcaatctctgcttctacccccagcaccaaggcctggggtctttgccaggctcctctcctactcagtagtcactgaacgtaaatgttctccaggccagaaaggtggtggatgctcctcaaagcctttggcccatcagtcctccctttcttcttagcttctcagccatcaaatgaaattgacaaatgaatttaagggaaaagtaggtttttttttttttttagatttatccgttttctatgatatccctatcttttacgctcttactgccccagtagctccaagtgccttcaaacatttatgttttatattttgttaagcttttctagttgtttttggtggaagtgttgttctgccactatccagtctattaactctgaaagtcagtttttatatttattaaagatgaagtgcaattgagttggtaggtttgtatgtttgtattatggtggaaacttcctgaagagagtgaggagtgaagcccctctagtctcccgtcacgtgtccctaataagacctctaccaccctgctgcctttgttccactactggactgagccttgacacgtttgaccctttggccacaaggaggagctgtgactctgctgagattcagagaacttggaggaaggagagacaattctctggatggcagagggttaatagaaagattgagtttatttacaacaagggaaaatgtggtctgcaaagaatgctagtcaaggctctaagtgtgagggttaaatacagactattcattttgctttgatatgcaggcgcttttgtgctatggaagagcctggactgtcagacttccactggagcgtgcatgggattagaaaggacaaggcatgagctggggagagtgggagcccacaagcagacacagatggaggaccccttcccaagaggaataagagaggctctgggtgctgggccgttgctccagctcagcccagtacagctgagccctgccatgaagtgagtctggccggccaggggtcccttggggatcttgcagagaataataactcagggaaatcttcttatgagaccaaaggtgacctacagccctgttctcctcactctaaattatcggggaattaagctagaaagaagttttttcttgttcctcttctggatggtcctctgagtttttggagcaggagctccccacagtgataggaaacccctctcctaggcctgagcaaatgtttctatcaaaacagcatcaccagactcccttccagcttccatttccaagttctttccctatctacgaagaaccgtggaagctagacttgtccagacgtcaaaggatctgatgatgccaaaacacctggagataggaaagaaggtggcattgacagactgccaggatgcacacctgaaacgcactttgttttcactacaggctcgtgtttcacattttaaaaaagcatttggaacttccctgacttcttggaaatccaaaaatacaacaaagttacattttagtagactctagtcagtcatctggcaggaaaaagcttcaggatataaataaaagtataaatagtagtatatacatatatatactaattatttatatataaccttacatgtatatatactacatacatgtatgattatgtatacatatactatacataatatagtgtatacgatacatgtactatatacaatatatactatattatatatattctgtattacatatagtatatgtatatgcatgtattaccatatatgtatatatacatgtatgtatacgcatatattactatatatgtatatatacatgtatgtatatgcatacattaccatatatgtatatatacatgtatgtatatatgtaggctggatgactagagcctacatcaaatgtaactttgttgtattcttgaatttccaagaatcaagggaaatttgaaacgtatatatccaagtatgtagtgtgtgtgtatatatatatatacatacatgtatggtaatgtatatacatgtatataatatatactacatgtaatatacatgcatatattatatatacatgtatatatatacatgtgtatattatatatacatgtatatatatacatgtgtatattatatatactacgtgtaatatacatttatatatacatgtatttatatataccactaccaaatacatgtgtatatatatactaccatacatgtgtatatatatacactatttttatatataatatatactacgatacatgttctagcatattgcctgaagtaaaagtccagccaaatagtttaaaaggaaaaccatgagccttcctgtgaagattaattttgcatttcatcttgaaatggaacaaagaaatctactgaagatagtcaattcacttctatatacggaagtctacatttatcagctttctacagtatgagcgactttcaaatctcctaaaagttacacaaatcagaatatgcagaacacacatttctaagctcaatattaaatatgtaaagtgactaacttgaacgtaagagttggacgttcagggtcctcctgtgatttcttcattcccaccatcacaaaacatctacaccttcttctcagtaacaaaaatgagatgacataaaatcatttttcatagttaataaataatacctatgcatcatgacattgcattgattttttgttaatggttgttttcaaatgactataaattaaacatttataatctatacaatagaaataataaatgtaaatattttaagtggatacatgagattttagtagccaaacaggctcacacctgtaattccagcactttgggaggccaaagtgggaggatcacttgggcccaggagttcaagaccagcctgggcaatatagggagatcctgtctctgtattttaaaaaatagttatacagaaaagtaacatgaaatagtctgcaacaggatgtcctatctgggtttgatctgaatttccatttagaaaacagacaggcactggtccatctgcgggcataggttctcatgaattgatgtgcatgttgacttttgtattttgtcaaagttaaaggagatattttgatcagagtcagagccacaagtaactagcaggaaactgagtgggatggaggttatgccatggtccttgcttccttgcagagctaagaaaccagttgtgagcaccagcgaaaagagacaaagtcagatgaaactgaaatcttcatgggactctgtgcccaagaaaaccagcttgacaggattgggcacaagagctattccttccatcctacgctgccagagcacacagcacagtttcccccatgagctcttggggagctggaggagggagatagctgtgctgggcggagtcgtattcccatgggaagtccaaaaagtagaggcagggatggaggttttccttctagaaagagtggaagattttgtttacaaacgtacccatacacatgcctttctcccgaagacccaaactttggggaattgcttaaatataacaaggaggttaaatattggacagccaaaaataggaccgaagccaatctcttctgaagtaggtgtagtcactgtgcattagtcagatattcaaatgagcaaagattcaagaggaaaaaaaaaagcattattggaaaaggaagcaaaagatcaagagaagaaaaccagcctgactctgagaggagagcccaaaagggagaggaagggaggaggtcctcagatcccgggtagggagcagggagggaggggtacaggcacaggaatgactgtcagagacacatcctggaggccacaagtccactctctcaactattcccagaaattccaaaaactcctttaaagaagccagtgcagggcatgaaagggaggagccatgctagaggagatcctgggaatgggggaatgattacaggctgtgacctcaatggcacagcacctctcagaggcagtggaaaccacagcctagtcttctcaccactgcagaccagaatcctgccctgggccttgcctggtctgcctgactcggccatgggctgcaggctcctctgctatgtggccctctgcctcctgcaagcaggtgagtcctgggcccaagtgacaagatcctgttggagtccccgagccttttcaccatgacaacaacaggaggctacctcctgggatttgcctgaattctgcttctttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagccaagacacagccttacagagccactgcatccctgtgcacaaacctcccggctcagccaggaagctgtgggccgtgtgtgcacctgcacccaaggctccagtctccattccctgatggcctctgatggagtttcagtctgtagtacagcctctgccagtgcacctgatgtggcaattctccattttatgtacacagaactctcagaattctgtttatcagctaaagcaggggttcacaacaaagtcagcaaagtatcagagctcaactaacaaaacaggagcctgtcccatgcactgaaggtctttactgatgggagaagccatttcttgtctttgtctgctgcacatatgggtccatattttactaatgttatgattataaacacactgtaggcaaaaatggttgatgagcctaagcataaagaagaggggaaggaaagtatttctaagatcaagagacaatttggattatcagtgagtattttgtttgacagagaaatattttgagaggcgtgaaattccatggcaataggtaaactggaaagtgttgaggagaagtcagtggaggcagccttgtgcattgtcggctccttctcttcaagaagggtgaccagcaagagtttctcccaattctgatgagtgtcatcttgaactctcctcaagagcaggtgacagctggatgacaggggatattgggagacatggaaaggaatttggacacaaatccctaggcagtggtgagccactggtcctactccaagtgaaacaacatgatgaaactgatattttggtacaggaacactggtagtagtatggatcagaaaagagatagatttttgggtggcatgaatgattaggagacttctaaataccctccatgaaagactagaaatcgtttatgtaaagcattgtggacgacataggcttgaggctctggattatgttatctcttggaaagagtgttgggttttattctgggacggttgaatgtaggacttgctaagttctatttcagctttgcccttcctcttagggagccccagcctgtggtcatcattgctagtgcatggccttcccagggtcttagtgggaatcacagtgtattcgccacatcactccactgcaactgggtctgaatgccctggctcttctgaaatctctgcccatgtcttcagccttccagaacttgttctctgctcagccttctggtctcccacccttctgcatacacaatttaggatctgactcaggaaaaaaaagggggttttcttacatataatttttgggttcctttttagtactctgtgtcctaaatcccacgtgtcttggagtcagttatgtcctatcttcagtcacatatactactgctatttggtacagacatgtttacttgactttacttcacgtttgccattccactcttcactcttctttcttgcaattcagacagtcctgaggtcattttccttcttcagatccatcccatattcagatgacttaaaatcacctgtcacccatgctgtgctttgagaaatgtttatgttagctactgacatcagggcagtcaagcctctcattgtcattgttattcaaggtaggttgaattccattaaaaaataaaaatccttgaaatttggtttacttattgggaaccacacaatgatatcaaattctttttaattcaattttttttcttttgtggtggaagggccaagaattgtttccttgctgaagcagactcctatcataataatttgaatactaacaacgttattttaatactaacaacgttaacctttaaatcagattgatgttaggttcttatctaagaatgaaatatatccaaccgtagcaggttgaaggtctctcatatatgtaacctgttcaggacgagataattcaaccactttccttaaactctgatctaaatgcctttacattctttgttttaagggccacataaaaatactctgaaacaatttacacatcagaaaaatgctaatactttcctcctggcccagcacatctccaagttaaaaaaatctctaaattctcaacccatagtttaatcatggtaactcccttctacccccaacatagatttttatgtaactgatttgtaactacaaccctaaccctacaatcacaattgtcattacaaaatactaacaaacatgtgctattaccaatagatggttaaaatcacttagggattatgaatcatgtcattcttgtatttatttgtacttattctttgtgtttatttattatgtcagcttcaagctgatttccctttcccttgctccccacaccttttgttgttccttttcagcatcctgtgtatgttagctctaagcccagccaagccccatgccctccacttcagggacagagggtggctcatccctttcgtgctccctcagctccctccccagtgcctggtggctggttggcatcacagccatgcccttgaataatgggcgctggtccacactgcttctgtggtcatgcagtcatcctccctccacagagctgggccaaaaagggctccactgcccttaggcattgagggaatggacattctgagtggcactgtcttgtgtgatcccacaggacagaaggagattccatcaatgggagtagtctgttgctgagagggatcctgaaagatagggggacagagacacactgggaggatccacataaagaggaagcagctgagaacaaaggagcccctgccagaggaatatccttggggagtaaaaagctgactctgccctttctccccagcccattcatcccagcccagacaattcaaatctaccttctatcaggacctagaaaggatgtaaaacggctgggtataaatatcccctgggtctggggaaactgtcaggagcagtgacatcacaggaaaaaccaccaaccaaggccaaggagaccagagcccagcacctcacccagaggaccccagtcagaggccccatctcagacccgaggctagcatgggctgcaggctgctctgctgtgcggttctctgtctcctgggagcgggtgagttgggttcacatcagctgtccttgaattccaagctttttccttgtgatttcagcaacaagcctcctcctgggctctgcctgaattttgtccctttccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagccaagacacagccttgcagagtcaccgctttcctgtgcagaaaccttaggggccctccaggaagctgtgggggccaccaaagccttcggtgaacatttcctgcaagagccccgacagaagattcagaacatcatagcacctgctcattcatccatgtggcaacgttacatcctatgctcatatttagagtgtgggttttctttagcgtgtgactctgccctgttaactgatttgaaaaatgataaacacattcagatctagtctttttaaaatccctttttaaattgtaaaataaagcaagcatgctataaggggattgtttggtttaagatgttataagaccctctcaacaaccacctgcgtcactacagagtcataccctgcactggaccacagagtgtcctgtgaggagccaagttcttctgacactttatgcctggtggtctccatgcctctctttctcagtaaccaggggtccattctgtcataggttgctgacacccaaggtcaagcagcactgggtttgggggaatcatagaggcaacttccaggcaagggtcccagggcgggagccagctggagagaacagtagacaactgagcttttggggaatgggtttgagaaatatctgtcaacccaattctattattctatcttccatcttgtctcttctctattgttcttatttaaactccaagctagagcgtaaattccagccctgatcaaagctccatatccctcacagacaccttctctgaaccccgcaggcagcaaatgtgcctctgtccactcccatttgtgtgggcggtaagccacccaagtcctgaggcaagagaccgagggcacgagctgttccagtataataaagaaaatatataaaataagaatagttatactagtaatagattatagatatgatggtatacaaatattatgaataatcagtttgtagcattactcttcattccaatattataataatccttgctctacaattataacctaggaaaaaccaggccatacagagataggagctgaaggggcacggtgagaagtgatcagaagacaagagtgtgagccctctgtcatgcccagacagggcccctagagggctccttggccttgtggtaaccccagagcctgggaggaagccccttgcctagaggaccttggtctagccttagcgtcagtgcctagaaaaagcacccattacttagccgaccaggaaagggagtctccctttccccgggggagttagagaagatattgcgtgtggctaggcttggtgctcacgcctgtaatcccaacactttggaaggctgaggtgggtggatcacgaggtcaggaggtcaagacgagtctggccaacatagtgaaaccctatctctactaaaaatacaaacaattagcgggttgtggtggtgtgtgcctgtaatcccagctacttgggaggctgaggcaggagaatcacgtgaacccgggaggcagaggttgctgtgagctgagatcttgtcattgcactccagtctgggtgacagcgtgagactccacctcaggaaaaaaaaaaaaaaaaacgataccgtatgtgtgaatgtgtgtgtgcctatgtgtgtgagtgcgtgcatgtgtgtgcatggatgtgtgtgtgcatgtgcatgtgtgtggatggtgtggatgtgtgtgtgtgtgtgtacgtgtacatgtgtgtgtgttcttgtggaaactcacccacatggacccaggttctctgggtggcattactgagaggtgctgggtcactggtagagctcataggcagttctggggagtgacaggaaatgtcacagccaattgaatctgcctaagttacagctgatagggttgtttatttcaagattttgtaagttcagaaatagatttataaaaaatccaagaattttctttctaaaatgcactacctaaaacttgctgataattcatttaaatacaaaatatgagaacatgggtctgattaatcaaaaggaacgattgaatacagtttccaggatagggctgtttgatatcttcacactgtttaaatctgtggcctgtatttttcaggctcctctcgtccatcctagcatactaattgcaatgctgtaacattgtttattttgcaatcaaaatgttggttaatgcttgcttttgctagctaaaggtgaactttcagatcaaccctatattggcccttctgggcaagtatacagagggtgtgtgtgagagggtggggattgcaggagtgagggcagggcatctctcttccttctctggacaatcttgagttcatcaggccaggtgtgaatccgtgagactgtggatctttggccacttggaggcgctgtagctccacgatgctgtaagaaaccctgggcagggctggagagtggccaggagaagagggttgaaggggatgcctggctgcctgctgccatcaggggccctttgggattccctgagtgggcctggacatgtggaattaagcacagacccctcactgccaaagaagggtagggatgctagagtcctcagtttgtaccaaggagggagggtgtctgcctctgcgtgggcagtggagggtgaaggggctggggtggcaagggctgggaataagtgtcaggcctgggacagggaggacacaggaaaggcaggtgtgatggggcatgtgggggctgtgctccacccgctccacctttagtttcagggctgtgtaagacaggaagatctcatggagtagcaaagcctgggccctgccaatggttgcagagtgcaggggtggccggcagagggagtaactgggaaaggccagttccccaaggaaatgccagaaactttcctgccccattcagaaagtgactgtgaggcgggtgcttccagccagaggggctcaggccctgctgagctgacagcgttttctttcccagacattctctgctgcttctatatgtgatctgttttaatgctcactgaaatcacaagtatttattattttgactgtttttgtatctgagggaaggcagctgtccctggtctcatatttaataactggctgtcgtgtgctctccaacacctctccaccctccctactcagtacatctgtcccgtcatctggcttcctctctccaggtcccattagcaggaggggaaggtcatgcctcctatgtgaccattagaacctcttccttgacaagtccaagaaacacgtgacttccgggccaagcatatccattcattcttcattgcagccaaaagaaagatgaaattttctaccctgtagactttctgtcactaatgcaatgtaccttgaggaaaagtaacatgaataactgttattcattagttaatttcttttatatcctttattcaataaagtctttgagaccctttctttgtatattttatgacataaaataaaaaatgggaaaaattgtttaataacaaatatttcttactttttagagtattaaggcttaaatttattttgttttattttagttttatattcaaagtactttactcagtttctgaattacaaaaatttccctttctttctctgtctctctttagctacctccctcattttttttgccagcattttaatttaatgtggtaggaacatgtaacatgagatctgtattttaaatagatttttaagtgtacaatacagtattgtaatctacaggtacaaggttgtacagaagctctctagctcttacttatcttgctgaactgaaattttatacctgctgacagcaactccccattttctccattcccagcccatggatatcaccatttttatctttgctttcatgagtttggcttttaggtagcctgctataagcagaatcagggagtatttgtctttctgtgccaggcttagtcacttatcacagtgtcctgcagctttatccatgttgtcacgagtgacggggttttcttctttttaatgcttaataatataccattgtatgaatataccacatttatggactttgactgtttctatgaaactgtctgtcacataagtgggagagtcatttgcagaactgaaagcttggattacatgaatgggcattcacatttcaattctactccatgggcaagacggagaataaaataatgattccatcatttactcttactttgctatacacaaaatagaagtcctgcttttgggaagtttcagttatttagaaattcgactgtcagaagaaaaccctaagacacaaatgcttttctcattgtacacgtgagagaattggctcattggttaaataacctgaccaaattaaatagctattaggatgcagtactgatcctccaaccctgcccagtctaagttccatgtttatagctctatgctataaaatatttcataaagctgccaacctagaaaacattggaaagttttcccctacatcccctttaggcctgctggctctaatagcatcatagtcagagatcagtttaccctggagatggtggagtagggaaagaagtctgaagaggcaccatgactccccgccctgactcccactctaacaccagctcatcaagacctgaggccagttcttaacgggttaacttaagtttttcagtttttttttacctataaaatgagactactactgtccatcagcagagttctagataacctttaatggcataaaatatctagcatatagtagaagcctagctattttgatttcctttgctgatctcagacaacctcgtccaccacaccaatgtgcaaagacagatatggacacattctgccaagaaatcttaggttgagggctcagaagtcacagaaatggaaatatatatgcctgataattcatctgataaaattaactagaggatgtagcatacatatctcctcaggcatttaaaaatcaacattattgatctataaagtatatgaagttaacaggacaccttttaaatgaacatatctgtgatttttgagcaacatatatctatatatgcaaccccacctctatgaagatgtatctgcatcacccagaaagtccctcactcccctctgcaatgcctctgtctgtcccagcaaccaatgatgtgacttctatcactggagagtcgttttgttggcaaatatttttaatgcaaatgtcaaacctcttctgaatagtcctgttgaatacatagctaaatcatcaaggcagggaggagttcctgggaggttttatggttttagaagtggttgaagctaggtgagctacctgacccatggtagggacaattctatctggagatggatgttgtgccgaaataacctcaaaaggtcttttcggctggtagaagctgattctacaaaatttattcattttcattcgtttattttctcgtcaattcattcaatcaaacaattttatgttacgttttgacaaaagttaatcatctttaaggaaattattttgagttcccatcagacacacatgcagctgggctttgtgttcacacagtgagcatgctggggtcaagcaaaccatgatcacagtgacttcattgacagatgatgtcttattgggagaagggttctctttgacttgaccccatgtgtccaacccataaaacctgagccttaggctaaaatccatcttccttttcttaccctgccttgggcaccaggccactgtgctgtgtgtttctctgtctcctgaagcagagtcctgggcgcagatttggaacctattcgtgggcttgtttgatcccagctgtgactttcagtaccagggggtcctttgctgtgacttgaatttgtgttttctttactcttaagttccacagatgctgagtgacccagaccctggtcatgctcttgtgctgaaaggaaaccagcacacggggaggtgagcagtatatgaaacaaaatcatgtatttacaaccagtggcaagacttactggcaggtgctttgttcaaacactgttaggaatttgaagatcatggcagtagaatgtgaaaccaagtgcagggtccttccaaatgcaggcctctgtgcaccaaagatagacttttggagctcattttttttaaacaaaaacggaaacaacactctatgttcatggctgtaggccatgcgagaatatttttttaaattttaatttaatttttatttttccatatattattggggtacaggtggtatttggttatatgagtaagtttttagtgatgacttgcaagactttggtgaacccaccatctgagcagtatacactgcaccatatttgtagtcttttatccctcaccccctcctgctgtttccccaacacttccccaaagtccgttgtatcattcttatgcctttgtgacctcatagcttcgctcccaaatatcggtgagaacatgctatgtttggttttacatttctgagttacttcacttagaataatagtctcccatctcatccaggtagatcattccaaatgctgtttattcattcctttttatggctgtgtagtatttcatcatacatatatgatatatatatatgatatatatatgatatatatatcatatatatcatatatatatgatatatatatatatcacagtttctttatccactcgttgattgatgggcatttgggttggttcctttttctttatcactaaattaatggcagcaataaatccagaacattccttattaccctaaagtcagccctgtctcccaaactcccttacacatcaggacacctttgtgcccatagatcatgggcagtgcttggcagccaccactgtgcacacagagagggtagtcagtagcgttaggtggttctgcctgctggggtctcaccccaggaacagaaagcaggagccctgggtggagctgaaagtgctcatctgggtttgtcaggagtcccatctgtcagtgaattcacaagaaacagaacaaaacaactcttccaatgttgatgagcctgcccctgggatttggaaagctaataacagagaaaaccaatatagacaaaagattttaaacaggactatcggattatggtcatttaagcaaattagaaaaggatacttgaaggagtatttgggacacaggaatcaaaaacaccaggaagacatgaggagtttttccaagattgtagactatagcaatacttagataaccaataccagtgtattaatgagtaattattagtattattattttgagatggagtcgcactctatcatccaggctggaatgcagtggcatgatctcggcttactgcaacctccgcctccctggttcaagaattctggtgcctccgcctcccgagtagctgggactataggtgcacgtcaggatgcctggataatttctatatttttagtacagatgggatttcaccatgttggtcaggctggtctccaactcctggcctgaagtgatctgctctcttcagcctcccaaagggctaggattacaggcatgggccactatgcacagccaagtaatttgtatcatcatgggaataaaaaatatacattgagttacaaactaattaccaaaagatatttaaaaaatggtagacttgcatcgattcagacaaaggcattcttcccatccaaactgttcactggtgcattgatcttgaatttgaccatctggggaaggggcgtggcctctcctgacagcaaggctctggggcccaggcagggagaatgaggtctcagaatgacgcccttgaaagacgtgttcccttttcaccaatgcacagacccagaggacccctccatcctgcagttcctgccatgagcctcgggctcctgtgctgtggggtcttttctctcctgtgggcaggtgggtcctgggcggggccccttgtgtggatttcaaggcccatcccctttccactggagctgtagcatcagctttgtccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttactccacagtgctgcacggctgtctcctctctgcacagaaaggcaagggaaggtgctgccctcctccgcagcacagattcagcgatgcccttggtcctagcaccgaaaactttggagccccaatgggcccgggcggtgcgagccttcatctgtgccaggtgcctctgcagtcggtctcggccaggcctggatcggtcccaggacctcagatgtcttccttgttgccctccggtctttcctctgaggtgtccttttgggctagtgccaggggtttcccagctctgactttcctagtcattcacctgagtctgaggcctcctaggtgaaataggatttgtatttcagatccatctagactcccgtctctacctgggtaccacgtgctttcctctctctatgatttttcctcatgttgaaccctacggtggtctcagctgcagcctgcatttcctatattcacagtcgccctccaaggccttgctgggtttctcctccccgacctccctgcccttctctactccagccatgttgagagactccaaagtccatttcctgtgccctgggctggagccttcctttctgtagtggtcaacacctacctgtgcttcagatctcagcatcatcagccctagtgataatcaccattatgcttcccttggctcccagctgaggtcagtttccctctcataatctctcatggtatcatgtgtctgttaatcagtagaatttagcacagttggaatcttccaagtactttaaaccccatgaaggccaaggctatgcctgggttataaatcagcagctgagcctggcacaaggggagatgcatttcagagaatggatgagtcagtgatggagtgagtgatgagtggatggatgaatccataacaggagcaccctagatccattttacccttgcggagatctggctgtaagtacaagaactcttacccttttgattgctgggctacgggaggtccttgaaattaatggggagtcgctatcatgggcggccccaccttggtcaaagattcctcctgagtctgcagcaccagacctcctccaggtctctgtgctctccttcagactctttcccacaacaactctacacagatcagagatccctttccagaaacccatgcatagagttgtgttattttggaaccacttctggtaccaaaaactccattaggtttacatcaataaaacagaatcactaaaagtactatggagaggaggatttatgacaggagttagaccttatataaatgtagggggagctgaggaagagaaggtctggaggggagatatagctaggcagatttaattcatgattaatgtgaccgtgacctcttattctactcaaaggagagcatatgatttcaacaaaaaaatattgattttcctttgtaaaagtttgatccaaatagtgagctatttttgtcccataattgtcttaagttggctaatggtggaacaaatccgactttgatttccttgaaagaacaggaaaaaaaccgtcattcatatacagtcttacaggctctattttatggaggaagcataataaataggaaagagaaaatcagaattctcttctggaacctacattgggactgtcctcagagcaggttgtgatgtgaggaatcaaatctacaggggtatttcgcagcttggagcgcagcagactgttcccgaccccatgcatttgggggtgagaccagagacagttgaaaaactatggaatcttgacattctgcactctcaagcctggcctctccctgaatttcacagattaacatcagaccaatttattccgactattaaaagtattagaacaaaaaccaaggaggaccagtgagcagaagcaataaaccattaaaatggacatcctaaagatttaaaattttgccatcataagatgtgaacgtttgaagagctgcatttaaatgaatacaagaagggactgaaacaagaatacacacaaaaaagagacggcccgaaaccatcaaaaaacattaaagaaataatcaaatagaatgtctagaaatcattacgattactccacaaaacaaaatggaagctaaacagcagattcaatgcttctaaagagattgttagcaatatcaaaggaggatctcaagaaatcacctagaatgcagcacagaaaattaaatgtaaaatataaaaaaagtgaaggaacaaggaaaaaatgaagtttctagaatattagaaagcatataatgttttattgaaacttttcttactttcttgtatataactgacgtttcagaaagagaaaataaggcaaatgatctgaggtgattgtgtatgtgatgctagctgagaatgttcctgagatgtttgaggaccgaaatcctcgttcaagaattcagatgaattgcaagacaagtaggcaggtccctgtgaaactgcagaccacaaatgacaaagaaaagattttaacagcagtcaaaagggaaagataaatatcctccaggggaatagaaagaaagaaataatcaaagtcaagaaagaggattaaaaataactgttaaatcagaattgagattgataaaaaatacctacaggacaggacaagaaaatatggaaaaccaaaataattctgtgagtttgccaccaaagtatcttttcagagttatagttaacaagggtgggaaatgatcccagaagaaatgtatgagggcagtttgtgagggaacccatgtgatgggacaatcccgttgggcacatgtgagtgggggaatggaggaggctggggcatgaatggggatggcagaggggaccctgacttggaggaaagacaatgagctcatcccatggtgcctggtgttgggggcactgttggcacatcctacagaacgtgctcagcagacagaggagcggctgtgggatgagaaggtgaactcggagatgcagcgtgaggcctccaagtccagacagcatgggagcccaaagcgatgtcccatgcaataacgttgtttacaaggagcttataaatatttaaagtagtcacccaagtgtggtctaatataaatcctgtgttcctgaggtcatgcagattgagagaggaagtgatgtcactgtgggaacttccgtgtaaggacggggcgtccctcctcctctgctcctgctcacagtgatcctgatctggtaaagctcccatcctgccctgaccctgccatgggcaccaggctcctcttctgggtggccttctgtctcctgggggcaggtgagtcctcagacaccaaccattctcattgtgtgtgtgtgtgtgtgtgtgtgtgtgtgtgtgtgtgtgtgtgtgtaggggtgggctgtgtgcattcgtgtgatgactaaaattattttcctcattctgttcccaactttgtctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagcttagccacagcatggcacagtcgcctccttcctgctcataaacctcatccttctctctccttgcagctcctagacacccttaacagaggcttctctttgcttctccctccccatgggaaacaagtagatttggacctcagcttgtcctttgggtagaaagagaccacagatttacccttaagacacagtaactgtaaatgtgggtggtggaagcaatcgtggcccaccgggctattggagtcctcagagccagctcattgctctaaggcaagcactgggtgtcttagccttggccttcagggctgggacacacagtcttctttggggcctgggaggttgctgcccacatagagaagcttcgggcatggctgaggaacaggtgtcttcccctacatgtgttggggcatctgcaaggtctgaagcttcatccacaagaacattctttcttctgaagcctcttctgttacattggaagttttctgcaatacaagagcaaaccattcttcctgtttgatttaaaagtctttgtggcttttgtggccattacttggtgaatacagccaagataacaataagacttcgtttcttctgcctagtgtaagcaatgcgagttctttattttgttttcatttaccactgctcctgtcctgagagactgaagcatgcgtccactactgctccagtatcaacttggttccctaggaaatcgggtttctagaacctgaatgctgacaaataagagttgtgtacatgtataccatgcaacctgcgtttaaaaatgtatgtacatggtgaagtgactaaatctagctaattaacatatgcagtacctcaatccttatcctttcctgtggtgagaatacttgaaatgtactctgttagcaatattccagaatacaatccactgttactaactttagtcactgtgttgtacaatagatcttttgaacttcttcctcctatttgagtgaaattttgtatcctttaaccaacatctccccagcaccccatctccatcccaacctctggtaattgctgctctagtcttttgatttgaaataatttccctgaggtctttaacttgagaagatggagttttaaaaacaataatgcttatattacttttgttttgtttgttattttacatattgcaatatagtgtttgttgcaaatataaatgagtatactgtaataaaaattcttcacctctctttgagtgaagctacatttcacatatatgaaatttcaagctgtggtcagagctgacatgattatggatcatgggtttctgggagtcctcagagacagccctatacacaaaggttaagatagattatcccagacccagccaggacagaggtgccctgagtcctgcagagctggttggggaattatagttccctaaattcacttatcagaaattgtggtagctcagataccaaatttctttctctagcaaatgatgatcgttggcagggattgttctgaatccattctaattgttctatcaacagatcattccttttttagttgccctgtgtgtcctgggagtgaataagtcccaggcacagatgggaatttcctgaccttaggatgctgttccaaggacttccttgctagaccctgtctccagcttttcccacctttatcctcatgacccctaagacaaatggtcctaataatggaccagctctgaaacttaagattgaacagaacacaaaccacaactgtaaacactgatgctgaaagaagtggtaaaaaaaggtgagcagggtttcccacctgcactgagagttaacatacaaggacagcaaagggaaggttttattaataagcaaacaagaagcaataaaggccctgctccattgaatgtaactaatctctttgagttaaaaaaggagcacgtcaataaaagtatttcaaatcaaagtctagaagtttccaaaccagccagcacaaccctgagagctctgtgctctcagcaacttcagagaactcatcaatcctttctgggctcaaacttccctttgtccactcgaagacccagggtcacactctcatcctattacaaaaacaatgggctttgctatcgttgctgatgcctcatttctaggagttgagtattaagcactgaagagctttgaaagttgggcttctgagtcaattgatgtgctggagccaacttttctgactcacgagagacaaataggcacactcttcccagctccccattcagtgaagccatgttgacagcttgaaatccaccatagtgcctgtgttgatacaacagaaattggtaagtactactaggcatgtgcccacctccacagacactcagtgtaccagcacatcactggaatgttttctgagacagtgatgtccctgttatgtcgtcatgtcttgtggggccaaaaggactccgaattcacctcctctctgttcttgcttttagaaaccataatctaaaataacctcacctgacactatttctattcaatctccaaattccctcactttgtgggtctgtgtctcctgtaagcatgtcagtccacaacttgacaactattttgaatgtagctaaaggatacagtgaaccagtttattattttcaaattatccttccttgcatggaatatgtagatgctgcagtcattgggaacagagatggggcaagcagcagctctgggccgtgaaccactttagagtcagacaattcttcagtggcacagacacacccttgggcatggactaatttgctttggaaactaagcagttccacaccagtcaccaatgaccttggatctatttccagctgagaggtcaaaaagatcacactacctaaatgtcctcctctccaatatatagtacagcccccatccatctcagtccctggaggtcatccagagctcccagagaatctctgctctggggcagaatcaccacgtctcctcctcgccagctccccacaggctccagcaaggctttcctgccaggtgcagggcatgggtgtggctctgctgtctctcaggtagagggaggccatacgatgatgtttgtataagaaggattgggtttcagaggttcctctcaaatacttgacataattttatttgctttttgtttcactctacaatgtcaccatttaggagagcaattattttggttgcattatttatggaactttgaaagatttttgtggttaaattaatttaagaaatcattcccattgtgcatcttttctgttcagatataatctgaggcagtgaaagaaacagcaatgattctgaaagcagtcacttacatgccctctgataaaggcattgttcaaggttcattactcacacctaactttcagtctactggaaatgaaaggcacagagttgggggcctgtgatcaagccacaagagaggactataccagctactctgggacttcagggcacgaagagatgacctcccctttagactctgctcaacgacgaaggaatgagttggtccatgggaacctgaggagcagaaattccgggagcctttaactgggacggagcaaggactgtagagcaagtcattggaaagggaaatggttcatctggtctgtcacagaagatagtggatagaaaggtcatataatccccagttccctggctgatttgcttccttatgatactattttgcagcagcgtaccgtcatctcacaccactcctctacctcttccagaatcatctcctccctctctgctgctcagatcagcacatgtgcattgcacaagctattcttttactgtagcagaccttttgctggtcttaattatatccatccttattttcccattagatactgctccctccatgattgcttattgccttgcaagggatcctttaccccgcgcccccagacagagtctcactctgtcgcccaggctggagtgcagtggcgcaatctcggctcactacaagctctgccttccgggttcacgccattctcctgcctcagcctcccgagtagcgagtagctgggactacaggcgcccgccaccacgcccggatgattttctgtattttttagtatagagacggggtttcaccgtgttagccaggatggtctctatctcctgacctcgtgatccgcccgccttggcctcccaaagtgctgggattgcaggcagaagccactacgcctgaccaagggatcctattttttatatcccagttttactttttattaacacatatctgaccccatcttgaaggtaatcacattatctgcctagacttttgctaatctttatttttatggtaccattgtcatttggggggacatatttgtttatctttggtaatggaaatgaaattacgttacacttcactttctgtgttttcttcctactttagggtaaatattatttccttctattcttcctattctattcctctctctttagatagttttaagggagaaaatgtcagtgagactgtaactgcagctatggggtaagaattatttagaatgagggtgggatattaagcttgataactcaaaggaacagtcagggttaaaactaatgttgggatcggggttcagagaagttgcttgtaaaacctgcaggatggcacttctggaatagtctcccggctccctctgcagacacttcccagcatcccttgggccatttcccttgcaaaagcaatgatgaaatttcacttattggccacaagatggcactgtggtccactgggctctaagagactctggggagagcctgggagagcagcctaggaaggaaagggttaagaaaaatcagggctggcatccaatatcatgcagatgttgcagcagttttcagttattgctagactacctacagttatacaacatacaggaaatacctctaatctttaatgagatccacagttgaagaagtttggcctggcagccttggtgtcaagggcaggtgcagacagaggagcaactatctcagaggaaaatgggaaagtgaggggtgggctgtggcttaagcccagtgcgtctctgctgcaccccgtcttccctgcagctcttaccaggcaacagcctccatgagagtaggtggatcctgcctgagcccagtcagaatgccccggactaggtgaactctgtaggcatggggagtaacacaacaggcccacctttcacacgttttttttttttttttttttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctcacacgtttccaaagtctgggctccaagcctttttttcccctttcctctgcagagtcctgccacttctgaagccttgtcctcactttctgcctgcctctcccacagcccccatggaggcagggatcagccagataccaagatatcacagacacacagggaaaaagatcatcctgaaatatgctcagattaggaaccattattcagtgttctgttatcaataagaccaagaataggggctgaggctgatccattattcaggtagtattggcagcatgaccaaaggcggtgccaaggaagggtacaatgtctctggaaacaagctcaagcattttccctcaaccctggagtctactagcaccagccagacctctgtacctctgtggcagtgcatccgcagccctgcacagccaactgctctctgcacaaaaaagggcagccacaggctggaggtgggcactccttcccaaggcctctatctcaaccaggagataaagatgccttttttgaagctcttctcagatgtcccagcaatgggctcccagtctgtgcatcctcctgcagcaggaacttcagtgtgagctgaggtccatcactgtgatgtggatgcacgaatgcaaacaacacttaatgttattttactcaattcagaatattctggcagttgcgtaaaataggaatagtagctcccaaaatgaaatttgtgtctcattttctttatgagagaaaagaaaaaaaaacagaaagcagctgggcagctttaacctgcttgagtgatctgggattctacaagtctacaagtggtacaaagaacatcaccttggcctggattccaatggataccaaacactacaaaaagtattgaaaacaatttataaaagacctaagtaaacaatctacttataggaaatgttagtagatccatcgcatagtgccattatacctgacgatgatcaactagtgaaattattatgtagagattatcagctaagcctctacttattacctctgagcatagagcagtgtttgagccttctgagggtatcttaaggaaggaacttaattcttaccattactttggcttggattaaaatccatgagcttgtcgtttttattgtaaaatattacagaataataatgatcaaacgttttattttcctctagcgtttattcctctttagaacgtgcaggttgaagctcacacacatgagcagggttccttaagatgagatccattaactccaggactgggaggtacacagctggccttcacaggaagtgcaaaccccaaatgcagtgacccctcctgtgtctacgctgtgcccaatacccctctgtgaggctgccataaaggcgggcaggctccttgcttggcaaaaaaatcagttcaccaattggccactttgctgaagaccagaataaaaggctaaattgtgagaatgatgaatgcccaattcccaaattgtgaaatgtgtaacagttcacgattcttggaataatttcaaccatgtgtggtttgttttttttttaagtttttctttgtcgacagctttctttcggccactgatcctcagttgtttcccagccgccttgtcagctgatctcattttgatgctaatttttttttttttttgctagctttgggattatttgttcttgttttactatgtcctctaagtgtggtggtaggttgctaatgtgagatctctctaacttgtttatgtgggtgtttcgttctgtaaacaatactcctaacactgctatagctgtgtcccagagattctagtatatttaatcttggttttcattagtgccaaagaatgtcttgttttctaccttcattttatggcttacccaagtcattcactagcagattgtttaatttccatgtaattgtatgattttgagagatcttataactcttgatttctattttttttgtgctgtggtccaagagtatggttgacatgatttcagttttttttataatttgtttacaattagtctgtgtccaatcatgtggttgatttcagagtatgtgccatgtgtagatgagaagaatgtgtattatgctgttattgggtggagtgttctgtagatgtctgttaggaccacttagtcaaatgttgagtttagtttatgaatatctttgttagttttctgccttgacaatctaatactgagtgttgaactcttccagtattgttgtgtggttttctacgtgtctgtaggtctctaagaacttgttttatgaatccagctgaaccagtgttgggtacctatatatttaggatagtgaggtcttcttgttgaattgggccctttatcattatgcaatgcccttctttgtcatttctgataattgttggtttaaagtttgtattgcctgaaattagaatagcaacttctgctcttttttgtttcccattggcttggtcatttttctccatcgctttatgttgagcctatgggagttgcatatgagatgggtctcccgaagacagcatacagttcagtgtttcacttgtctatacaactggacgctctttttttttttttttttttttttttttgagatggagtctcgctctgtcgcccaggctggagtgcagtggcgcgatcttggctcactgcaagctccgcctcctgggttcacgccattctccggcttcagcctcccgagtagctgggactacaagtgcccgccaccacgcccagctaattttttgtattttagtagagacggggtttcaccgtgttagcccggatggtcttgatctcctgacctggtgatccgcccgccttggcctcccacagtgctgggattacaggcgtgagccacggcgcccggcagctcttttaataataaacgacttttatgtgctgtgtttagcctgtttacattcaaggttaatattaatacgtgtagatatgatcctgccattgtgttcttgcttggttgttatgcagacttgattgtgtagttgctttataatgtcaatggtctatgtacttgagtgtgttttttggtggctgttagtgatctttcatttctatgtttaggactcccttcaggacctcttgtaaggcaggtctggtagtaacaaattccttgaacatttgcttgtctgaagggatcttatttctcctttccttatgaagcttagtttggctggatatgaaatatatagggatactggttggaatttcatgtctttaagaatgttgaatattggctcccaattgtttctgccttgtaaagtttctcctgaaaaacctgctgttagtctgatgggattccctttgtaggtgacctgccttttctttctagctgactttaatattttttctttcatgttgaccttggagaatctgatgactatgtgtcttgggggtggttgtcttttatggtatctcataagaattctccgtgtttcctgaatttgaatattaaactctctagcaaggttagggaattttttgtgctcaatatcctccaatatgttttcaatgttgcttactctctctccctctctttcagggacatcaatgagtcataggtttggtctttttacataatcccatatttctcagaggtttacttcattcatttttcttttttttccattctttttttgtctgactgaattgattcaaaaataagtgttcaagctctgagattattttctcattgattatgctgttaatacttctgattacattatgacattgttgaggttagtttttcagctctatcagatcaattttgttctttcataaaatagctatttcatttttcagctaatgtgtcattttattggattcatcagattccttagattgactttcagctttcttccgaatcttgatagtgtttgtttctaacctgtttctgaattctatgtctatcatttcagccgcttcagcctggttaagaatcattgttgggaagctagtgtgttcatttggtgctaagaaggcactctgactttttaagttgccagagttctttcactggttctttctcatctctgtggtctgaggtttctttaatcttttaagctgatgtcttttggaagggttttttgcttttatattctatgcccttgagggtttcactgttacataagctgggttcaggagactggcttcatttatggaatatttcagggggctaagattcagctcagtatgtctgggctgcgtgttgtaggcctgtggtgctggaattaagcccagagctttggtttttgaccccttaaggttaaagcacctgctacaccagaggggctgaggcgttcccaattccactggcaacaacactgcaatggggaatgccagccaaagtactttttccaaatggtggcattggggtacatgctcagaagcatgtgccaataatggcaatgtggcagtttccatacatatgtttgtgctagcttttttattattatatagtaaacttctttgcctctttttatagttattgtcttgaaatatattttatctgatatagatatagctactcctgatcttttctggttttcacgtgcatgaaacatctttttgttatctcttcactttcaatctatatgtctttttaggggaggtgtgtttcttgtaagtgacagatcattgggtcttatttttatattcattcagctactctatgtcctttgattggtgagtttagatcatttacattcaatgttattgttgataactaagtactggctcctgccatgtatttgttttctggttgttttgtggtcttctcttcatttgtttcttctttcctgtcttctttttagtaaaggtgattttccctgataacgtgttttcatttcttgtttgttatttttgtgtatctgttgtatgtgtttgtatttaaagttactacgttgcatatgtttgtatttaaaattactatgcatgaggcttgcaaataatatcttatactgatgacaacataacactgattgcctaagcaaacaaaccaaaaaaaaacagagaaaactagtaaaaatcttatattttaacattgtccacctacctttcaactttgtgtcatttctatttatatcttaggcactgtctatgtcttgaaaagctgtagtttttttttttaattggttcatcttttagtctttataagtagtttacacgccgtaatcacagtattataatattgtgtttttcttcgcactattatcagttagttttgcacctgcagataatttcttatttctcattaatgttcttttctttcacgctgaaaaattatcttttgcatttcttctaggacaggtctggtgttgaggaagtccctcatattttgtttgtctggggaagtcattatttccctttcatgtttgaagggtattttcactgagtacactattctagtattaacgtttttttttttttagcattttaaatatgtcatgctgctctctcatgacctgtaagatttgcactgaaaaagtctgctgctagactatattggtggtccatggtatgttatctgtttcttttgctgcttttagaatcctttctttatccttgaaattttgatttatccttgaagtttgattattgtcttgatgtagtcttctttgacttaaatatgcttggtattctataatcttcttttacttgaatattgatatctttctctaagtttgggaatttctctattatcatagctttgaataaactttcagccctatctctctctctacctcctctttaaggtcaataactcttaaagttgcccttttgaggctatattctagatcttgtatttgtgcttcattaatttttatccttttgtctcctctggtggtgtattttcaaatagcctgtcttcaagctcactgattcttctgcctcatcaattgtgaggttgaaaccctgatgcattcgtcagaatgtcaattgtattttcagctccaaaatttctgcttgattgtttttaattatttagctctcttccggattctgaatttcttggctgtgttgtcttgaattttgttgagtttcttcaaaacagatattttgagttctgtgtctgaaatgtcacacatctctctctctctctctgggattggcctctggtgctttatttggttcatttggtgaggtcatgttttcctgaatggtcttgagacttgtggatgtttgcctgtgtctgggcattgaagacttaagtatttattgtagtctttgcagtctgggcttgtttgtactcgcccttggaaagcttttcaggtatttgaatgtacttgggtgttgtaatctaagttttctatctctgaaaccttatctgcattagggagcaccccaagtccagtaattctgtggtccttgtggactcacagatatactgccttggtggtcttggataagatctgaaagaattctctggattatcaggcagagactcttgttctcttccttcactttcactcaaacaaacatctctgtctctctctctgctgaactacctggaactgaggagtagtggtacaagctccctgtggctgccatcactgagaccctaggtcagaaaaagccagcatgataatgggtctcacccaaggtccacagtaaccactgccttgcttgttgcctatgttcaaggccccagggatctacaatcagcatgtggaaaagtcagccagtcttatacccttcccttcagggtcacgaggccccctgaccccaggcacatccagagatgttatccaggagccagggcctggagtcagaaaccttggggatctaactggtgctctattctgctgcaactgagctggcattcaagtcacaagataaagttatttccactcttccctgccctttcacaaccagaggagtctctccctatggctaccaccgccccaggcccacagcaagaattgcctgactattgccaatgttcactcaaggcccaaggactctttagccagcttgtggtaaatgctgccaggcctgagactcttctttcagggcaatgggctctcctctggcccaggactggtccagaaatgcaatccaacagcaaagtcctggaatccgggaccccaggagcctactttgtgctctactccactgtggccaaggtggtagctaatctgcaagacaaaggctcctttattattccctctccttttatcaagcagaaggagcctctcctcatattcatcacagctgggaatgtgctgcatcacacctgaaaccagcatgtctcagattctcacctaagctctatggcaagtactacctgggcattgctgctgattattcagggcccaagtgctctttattcagcagatgatgaatctttctgggccttgttccttccccacaaggcagcaggttcccttctggcccatggtgtgtttagaaatgtcatccaggagctagggcctagaattggggcctcagtactctgctcattgccctatctgactatggctgagctggtgtctgattttcaagaaaaagtcctctttactcttccctctcctgtctttaagtggagagaaggtatattaggccattctagcattgctataaagaatacctgagactgggtaatttataagaaaagaggtttaattggctcatggttctgcaggctgtacaagaggcataacactggcatctgtttctgggaaggctccaaaagcttataagtatgcagaaggccaagggagagcaggcgcatcacatcgcaaaatcaggagcaagagatagagagtggagggtgtattagtctgttcttatcctgctaataaagacatacccaagacggggtaatttatttaaaaaaaaaaaaaaagaggtttaatagactcacagttccacatgtctggggaagccacgcaatcatgacagaaggtgaaggaagaccaaaggcatgtcttacatggcagcaggcaagagagctttcacaagggaactcccatttataaaatcatcagaactcctgagacttatttactatcatgagaacagtatggagaaaaccaccctcatgactcaattatctccacctggccctcgccttgatacatgatgattattacaattcaaggtgaaattgggtggggacacagagccaaaccatatctgagggggagctgccacacacttttaaatgacaagatcttgcaaaaactcactcactatcgtgaagacagcactaagccatgagggatctgcccccatgacccaaataccacccaccaggccccacctccatcactggggatgacaattcaacatgagacatgggtggggacaaatattcaatctctgtcattctgccttttttctctctcaaatctcacatccttctcacattgcaaaatacaatcatgcctttccaacagtctcccaaagtcttaactctttccagcattaactcaaaagtccaaagtctaatgcctcatttaagacaaagcacatctcttccaccttactagcctgtaaaattaaaaatatatatatttactcttaagatacaacaagagtataggcatggggtaaacattcttcttccaaaagggagaaattgggcaaaagaaaggtgctacaggcgccatgcaactttgaagcccatcaggagagtcattaaatctttttgtttgtttgtttgtttgtttgtttgtttttgagacagagtcttgctctgtcacccagactggagtgcagtggtgcgatctcagctcactgaaacctctgcctcctgggttcaagtgattctcctgcctcagcctcctgaatagctgggattacaggcacgtgccatcatgcctggttaatttccatagttttagtagagatgggatttcgccatgttggccaggctgttctcgaactcctgacctcaggtgatcttcctgtcttggccgcccaaagtgctgaaatgataggcatgagccactgcacccagccaaagtcattaaatcttaaatctccaatagttcttgactccatgttccacattcagggcacacactggtgcaaagggggactaccaaggtcttgggagttcttcgtctgtggctttccagagttcagcccccagggttgctttcacatgttgttgggtgttttggcttgtccaggcacagggtgcaagctgtcagtgacaatatcgatctggggtctggagggcagttgtcccctttccaaaactccactaggcaatgccccagtgggattctgtatggggcctccaacctctaatttcctctctgcatttccctaatagagattctctgtaaggtttccacccttgcagcaggcttctgcctgatcaccaaagattttccataattctctgaaatctagatgaaggctgccaagctttcttgattcttgcattatgtacacctgtaggcttaacaccacatggaagccaccaaggctatagcttgcattctccaaagtggcaactcaagctgtatctgggcccctttgagccacagctggagctggagcagctgggatgcaggccgatgtgttctgaggctgggcagagcagcaggaccctgggcctggcacacaaaactattcactcctcctaggcttcagggctggtgatgggaggtactgcctggaagatttctgaattgtcttcaggcaattttcccaaagtctttgctattagcacttggctcttttttaactatgttaatatctctaacaagtggtagctccacagcctgcttgaattcttctcccacaacattttctttatttgccacatggttaggctgcaaattttccaaacttttacactctgcttcctgtttaaatatacattccagctttcagtgttttctttgctctcacatctgagtgtaggctgttagaagcagccaggccacatcttcaacactttgctgcttataaatttcttccaccagatacactaggtcatcactcgcaagttcaaacttccacagattcctagggcagaggcaaaatgcacccaagttctttgctaaggcataacatgtgtgacctttgccccagttcccaataagtttctcatttccatctaagacctcaacagcctggacttcactttccatatcactatcagcattttggtcacaaccatttaaccagtctctcagaaattccaaactttccatcatattcctgtcttcttctgagccctctaaactcttccaacttttgcccattacccagttccaaagctgcttacacattttcagttatttttataacaatacccaacttcttgtatcaattttctgaattaggccattcttgcattgctgtaaagaaatacctgagactaggtcatttacaagaaaaatggtttaataggctcatggtttttcaggccgtacagaaggcataacaccagcatctgcttctggtgtagtctcaaaagcttacaatcatggaagaaagaaaaggggaggcaggcacattacatggtgaaaacaggaacaagagagagaaagagagtgtgtgggggagggagggaaggtcatttaaaacatacttttaaatgaccagatctcacaataattcattctctattctgaggacagcatcaagccataagggatctgcccccgtgatacaaacacccctcaccagcatggggattacaattcaacatgagatttgggtggggacaaatatccaaactatatccgaaggagtctcacctggagctgtgggctgtgctgcctgaggttggggatggggtggcataagcaatttcttggccaccccagctggtatctcactaggtcatgtgtccccaagtccactgactctgagttcagcacagcaccaagacttgcccaggaattgtagtccttgtggcctggactgtgtttcaagtttatttaggaccctaaggcactttagcccatggtagcgaggctagccagaactcaggttctgactgctgggataagtgattcccctctgactagggctggtctaaatgttcttccatgagtgctggctgagtcctgcctgctgttgctatccactgtgtgaggacagcaacgacttccaacacaaagtcccacagtcactgcactctccctaacccaaatgcacagactgtctctccaagccatatggccactgccaggggatgggggaggcatggtattggcaattcaagagtgtcttttctacctctttagtgcctctttcagtgatatgaagttaaaaccaggtactgtggtcacttagttgatttttggttcttatgaaggtgctattttgtgtggatagttgttcagtttgatgttcttgtttggaggaacagttaacgaaggcttctatttggccatcatgttctaccttcttcttaatcattctattgggtctgtagtgatatctctatgcatttttctataagtaattatatttacatttttttctgttttcattagtaatttctatctccttttttcaagtgtctgcttttaaatttgcctgttttaaaatcttacgttgtttgttcttatattactaatacgtataatatgtttgtattttttatataaaccttttgaccattaaatatattgagttagtcttctcccagagtggcctgcctttgtactttctgaatagtgtcttctcatgaactgaaattttctattttttgaagtttaattcatatatatttttccttttacagtgactactctttgcatttcaaggatatcttgcctataacagaattatgagttgttccattctgttacttactctactcctcctcattagtagccccatccctttttctttgtcatcacttgaaaatgctaaatctccaaaatcacaaattaaatattccactatctgcctacagcttcttatcctatcatacctgttctttgatattattgacatctcctctccactggtaaatattctttctatttcctagggtccctacagaatttctttactcattctagagcagatatgaggatgctacgtgttaaaaatcctagcttgcaaatagttattattttatattgatactcttaggcttccctttcatttacaaaaataaacaagaataaatgcactgatctctttggcatggcagaagctgaatgctgtcagagtaagtcacaccggcacaaactgttatcatgataaatacatagtcactaagcttacctgcctttatatccctgctttgagattatagtatggtccttttactagctcagtctttcaccctcctcaaatattgtttcaaatatttaagacttttttccagtccctaattcttctcttcttgcctcttaagccaaaggcacatcttgttaggacatgctggaccttgcatctctgcaattaacacagtttttctactgtgtgaaggtgtcaccttgagtgaagatggttcttgcggacgggaacccagtgtggggctcaactctaaagggatgtggcaatgggtctgaaaatgggttctcaatgaagcatcacagtgtccactatgtttatgaagtagatccaccctgccacagacttctaggtaagagtaggtgatcatgcatcatgattctctactagaacctctttagattccatgtactcaagtcatactatttattttcatactgcatattttaatgcttctcccaactcttttggtaatgctaattgcatgtgatagaattttcgttactgctatttgcaaagagtgagaaattgtattatttctaattgcagaatgttagaacttgtattattttgttaaagcaaaataagatctccaagactcacttttccattgctatgtctattaaccatggtcctggaggtattgaggagggatgaaaagacaatttacaaaactgtggcaaggttaaggaacccagtaagagaagagaaaggattatggggatagtatagtgagtgctcttattcacattggcctaaaagaagtaggagagtgtgtggatctcggggcttttgacattttacatttggggtaaggatgtttgtagggtgctgtgacctttggtagagaaaagcaatcaatatgaaatagtccagcaaggaggcagccaggagacacacaaaccgggacagttggttaccctctctctctctctctcctgccattgtctctcataagacaaactcactctggagtacacaaaaagagatgcagttactataatccattggcatcaacctctgaaggcaggatggatctggagggataaacataacctgcccagaggatgactcatagggtggccttgtgggtgctgaatcccaagtggttaggtctgtgctgtgagctgataaagccccagaattatttatggggaatctatactcctaataatttacagacaacacagatccactttggacttgatcagatggacaaaatcttggggacttgacatcactgcgcacacaggggaggagctgggattgttgtccaggaaaggaaaatataaggagaaaccttggtttgaatttggtgtcagacatatgatgagaggacagccaggaagatctggaacatgaagatttaattacaggccactaactctcagctgacgggcaggtctgtgagttccagaatggagcactgcagcagtaggtggggaggaggctgagagggcgatgaggcagtctgagtgctgagggcagtgcagtcagagaagcaactgcctcatcacagaagcttctgcccttactcagcccccttgctctgcaggatgaggagggagttccatgggtagggaccactggacctaaggaagcctgaaggggaaggaccacaggacagtgacatcacaggatatccttcctatcaggaaaagtgaggctcagaactcagctcttcctgggaggaccaagccctgagcacaggtgcagtgctgcctgctccgctgtgccatgggctccggactcctctgctggacgctgctttgtttcctgggagcaggtgaatcctgtggacaggacagcacccctattctcagcttgcccacccctgtgtcccccacttcaccatggggaggcacaagttcattctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcaacttgatgcaggcctgcagagccaagaacattctgtgtacaaacatccctgccccagtgtggagaacttcagccctaacatatctgtgagaacttgaggactgtagtgggaaagaaaagcagtttcaggaagctggatcctaaaacctggggttttctgccagttaggagtggggataacaaagccaagagggtctgctcaggaggtggtgaaaactaccttcttcgccaaacgctgtacactatagggatagtggaagtgtttgtaatttaatagctggtgccctctttacagggcagcagatttaatttcagggtcaagattcttgataatagtgtggaagggaaaatcatagggtttgctttatataattcagggagaagaaagtgagatttggggaaattctatgaaagagaaaatgatcaaagatagttgaaaacagagatagagcagaaggtaatgaaacatggtgatctgtgcaccatgagctcccttctcctcccacagtttttgatatccagaaaatacaaagaaaggtcttatagcaactgacatcacctggggactggtcctagttggggatatcacaaatagcagcctgcctgatgtgagggccttggggttggttctgacatcttctttctcgacttctggatctagtcttgcctgctcgaggcacagtcaaatacttcccaaaacacaaaggaggtcaggtcagtcttggtcctaaaggtgcaaatgctgtccgttttctcccaagataaaattctgcatccctgggattcctctctgagactcagtgcccagattcaattaccttctgtaattaaacagttctttgaacattttctaaaactcatcagccttggtatcatctgcatttctgctatttccttggcctggaaacttttgttctctccagacacatccagcccctgctcatctgtcaaggatggtctcacatctgccttactctttgcttcttaccctgacattccctggaactggactgtatcaatttatttatttacttttttaagacaagagtctcactctgttgcctgggctggagtgcagtggcatgatcttggctcactgcaacctccatccccccggttcaagctattctcatgcctcagccttgagagtagctggaattacaggcacatgccatcatgcatggctaatttgttttgtattattagtagagacacggtttcaccatgatggccaagctagtctcaagctcctgacctcaagtgatccccacgcctcagcctcccaagtgctgggattacaggcatgagtcactgcgcccagccctggactgtatcactttcttttctttattttcataagaaaagccaagtttataattaatagtatctgaagtttgtaaaatgaaaaagttaatgcatacttatatagaatcctggaatatcattaatcaccatcttcccttcaatgggactcctctttcttaaaatgtaatgaagattcttagagacagtgtcagtttttcatataatttctgcaatattctaagcaattgtgtcttcatagtcagaattgataaccaatgctataaagtatcctaactctaaggctggaatttgcaaatactcttttggagcaaataaaattgtgttgtagtaatattcatccagtctcatgatcctgaaaaaacaaattattcagcataaccacactttccacagccacatttttagagatttgatgagactggaacatcatcaaagatgcttctcagaaatcaacctaaaaaactgaaataaaaattagttaagctcagtaatggaatcttatcatcctttctgagtaaaagatattgtgtgtgcaggaacagaaaaccaaacaccacatgttctcattcataagtgggagttgaacaatgagaacacatggacatagggaggggaacatcacacaccggggcctgtcggggggttgggggaaggggagggagagcattaggacaaatccctaatgcacgcggggcttaaagcctagatgacaggttgatgggtacagcaaaccaccgaggcacatgtatacttatgtaacaaacctgcacgttctgcacatgtatcccagaacttaaagtaaaataaaaaaaaaaaaacccaagatattgtgtgtgtgtgtgtgtgtgtgtgtgtgtgtttgtgtgtgtgtttgtgtgtgttttctgtggagactcagccgcatggaaatagtttctcagggtggcattactaagaggtgttgggtcattggcagagctcctaggtacttctgggtaaagaaaggaaatatcagacccaattgaatctgcctaagttatatacagctcatagggtcgtttatttcaagattttttaaaattcagaaataaatttgtaaaattgaaaaatcctctttatagaatgtgctatctaaaatctgggaataataaatctaaatataggccagacgcggtggtttacacctgtaatcccagcactttgggaggccgaggcgggtggatcacgagatcgagagatcgagaccatcctggccaacatggtgaaactccgtctctactaaaaatacaaaaattagctgggcatggtgacaggcacctgtagtcccagctgctcaggaggctgaggcaggagaatggcttgaacccaggaggtggaggttgcagtgagctgagattgcgccactgcactccagcctgggtgacagagcaaaacagcgtctcaaaaaaaaaaaaaaaaaaaaaaaaaaaagtctaaatacaaagtgtgaaaaggtgtggctctgattattcaaagggagctctggaatgtcgtgtttccagtctggatctgcttgatatcctcacactgtttcaccctgtggcctgtataattctggctcctctcttccatcttaggatactcattgcaatgatgtagcagcagtttattgtgcaatcaagatgtgcccttttgttttcactggccaagggtgaatttgaagttccaccctaagtcaacccttctgggaaagcaatagagagtgtgtgtgtgagagggtgtgggttgcaggggttggtgtaggggcatctctgctcctgacttagacaatgctgagctcatcaggtcagaaggtgtgaatccatgagactggaactttggccacttggaggtgctgtggctccacaaagctgtggggaaccctggggaggggtggagggtgacccaggagaggacggctgaagggaatgcttggctgcgtgctggcatcaggaggcggttggaattcagagtaggtcctgggactgcccagggcaaggtaggcacaccagggacctcagtttgcatcaaggagagaatgtctttgcctctgcatgggcagtggagggtgaagaggctggggcagcaagggctgggagtcagtgccaggaaagtgacaggggttgtcagagaaaaataaggtgggatatgggcatgtggagactgtgttccacctgccccacttttaatttcagggttgtgtaggacaggaatggtgcaggaagcagcagagcctggggtctgacaatgggtagagcaggcaggggtggcctgcagggagagttactgggaaaggccggtttcccaaggaaatgcctgaaacattcctgccccactcaggaaatgaccatgaggtgggtgctgccagacagaggggttcaggccctgcagagctgacaggcctttcccaggcactccctgctgcttctacatgtgatctgctttaatgcccactgatatcaggcagggtaaatatgattttacctgtttatacatatgggggaagcagctgtccctgttctcatgtttagtaactggctatagtcagttcctccaacacctctgcacgccgccctgctctgtacatgtgtcctctcctctggcttcctcatttcagatccccgttagcaggagggaaagatcatgtctcatatgtggtcattaaaacctcttccccgacaagcccaaggaacttccaggtcaagcatctacattcatccttcactgtaggaaagaaaaagaaataaaattttctgcactgtggactttctgtaactgatgtaatataccttgaggaaaatgagcataaatagttgctattcattaattaattaatcttattcttttactcaataaactttttgaggatccttctttgtataaggtattctgtgacataaaattgaaaagaaaaaatattaagtggaaaaaatgtttcttgctttttacagtgttaaggtttgcatttattttttaaattgttttctttattaaaaatagtttactgatttctaaattatacaaatttacttttttctctttttttggctaactagtcccattttagacagccatttaatttaactgtggtaggaatatgtaatatgaaatatatctttttaacagatttttgtatgtacaatacggtattgtaatctacgggcaaaaggttgtacggcaatctctagatcttattcatcctccttaactgaaattgtataccattgacagcaactctccatttactccaatccccagcccttggaaattaccttcacctttgcttccgatacttcgattatttacgttccatcatataagcagaatcatgtggtatttgcctttctgtgcctggcttattcacttagtgtaatgtcctgtgggtttatccacattgtcatatatggctggattttcctctttttaaatgtttaaaatacttctttgtatgcatctaacatgtttaagttctgaagtataaaatgtgtcatatctgactgtttctatgaaacagtctgtcacatgactggcagtcatttgcagaactgcaagcactgagtacactgatgcacattcacagttcaattctgcttcatggagaagacttagagaaaatattaatctaatcattcattatcattttatgatgcacaaaatagaaagccttcattaggaaaatttcaattaattagaaattcaactatacgaaaacatcttaacgtgtaaacgctattctcattttacaggtagaggaattggcccatagtttaaattacttgaccaaattaagtaggaattaggatgcagtactggggttctaaccctggtctatcaaagccctgttttttatagctatatactataatctatttcataacaaatgatgcttatcttcacaaaaattcaaatgttatctcctaggtccctttcagacctgctggctctaataacatcatagacagaaatcagtttaccctggagaggggggggtgggaaacaactatgaatgggtgccatgacatcaagcctgactcccattctagcaccagctcctcaagacgtgaggccagttcttgacagatttggcttagtttgttttctgtttttttgtttttgtttttgttgttgtttttgtttgtttgttttaatctatgaaatgagactgctactgtccatccgcaggctgtgtacaaaattaaatagcataaagtatctagcatgtagcagaaatctagatattaggttggtgcaaaactaattgaggtttttgccgttacttttagttacttttaatggtaagaactgcaatacttttgtaccaacataatattttaatttcctttgataatctcagatagcctctttcaccatgccaatgtgcaaaggcagatgcggacatatgatacctagaaatcttaggttgaggattcagaagtcacagaaatggaaatgtacatttcctctgatgatttatttgatgaaattaactaattaactaaagaatgcagtatggatccctcttgaggtatttaaaaaatcaatgttgttgacatataaattatacaatgtaaacattatacatcttaaatgaacagatcagtgatttttgagcaatatatatgtatatgcccttataatccccacccctcttaaaatgtaaaatatccccacccctattaaaatgtagactatctccagaaagttccctcgaacacctctgcaatgcctatcttggtcccagaaaaccaatgatgtaacttctatcactggagagtagttttgttcacaaatatttttaatgtcaatttaaaacccatactgattaatcctcttgaatacatagctaaataatcaaggcaaggaagagtttctgggaggttttatggttttagaagggattgaaaccatgagagctaccttgatccatggtaggaacgattctatctggagatggatgttgtgccgaaataacctcaaaaggtcttttcagctggtagaagctgattcgacaacatttatttattcattttcattcatttctttgcttctccattcattaactcaaattgtttagtaatgatatcctgataacagttaattatctccaaggaaattattttgagttcccataggacacacatgcagctggttttgtgttcacacactgagaacgctggcgtcaagcaaaccatggtaacagagacttcattgaaagatgatgttacattgggagaagcattctttttgccttaaccccaagtgtttaactcataaatcctgagccttcagctagaattcatcttcctgttctggccctgtcctgggcaccaggatcctgagctgtgtgttcctgtctcttgaaccacaggagtcctgggcacgcacatgaaacccactaatgggcttgttggatcccagctgtgactttcagcaccaggtggcccttagctgtgactttaatttctgtgtccttcactgctaagtgaagccccatagacgctgaatgaccagatcttggtgatgcattgtgctgaaaggaaaccagcacagggggaggtgagcagaatatgaaacaaaatcatgtatttacaaccagcgacatgacttactggcagatcctttgttcaaacactattaagaatttaaaaatcatgacagcagagtgataaagcaagcgtgggatccttctgaatgcagggctctgtacaccgaagatacagtttttgagctccttttcatttattactaaattaatggcaggaatcctgaacgaagggatattccctatgagacatgacacctcaaataaaacgagagcatttttccttatcttgaagtctgctccctctcgccaagtccctcactcatcaggacacctttgtgctcacaagtcttcagcagcgctgggtggccaccattgtccacacagagagggcagtcagcagcatgaggtggttctgcctgctgtggtctcaccccaggaacagaaagcaagactcctggatggagctgaaggtgctcagctggacttgtcaggagtcccatctgtcagtgaattgacaagaaacagagcaaaactactcctgcaatgttgatgagcctgcccctgggatttggaaacctgataacagagaaaaccaatatagacacaggactttaacaggattatggtcaattaagcagattggaaaaggatacttgaaggagtgtttgggacacaggaatcaaaaacaccagggagacaagaggatttttcctaagattctagactacagcaatacatagataactaacaccagaatattaatgaggaattatatcattgcaggaataaaatttatattgaattacaaactgtttgcacaaaagtcaagaaaaacttgaaagccttatatcaagaagcattcttcccatccaaacttcagtggtgcatttattttggatttgaccctctggggaaggggcatggcctctctcgacaagaaggttctggggaccaggcagagagaatgaggtctcaggatgacttccttgacagccctgttcgcctttcatcaacacacagacccagaagacctctctgtcttgtagcatctgccatgagaatcaggctcctgtgctgtgtggccttttctctcctgtgggcaggtaagtcctgggcagggcccatgtgtagatttcaagacccagagccttcccattgaggctgcagcattggctttgttctccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgactccacagtgctgcacagccatctcctctctgtacataaatgcaggggaggctctgccctcctccccgaccccagactcaaccatgtccttggcagagttctcagcactgggaatcttggaagcccaatgggtgccgggcagtgtgagcctcagtctgtgccaggtgcctctgcaggcagtcccagccaggcctggactggtcccagagcctcagaggtctcttttgttgctctctggtctttcttccaagctatctttttgggatgggaccagggctttcccagctcttacttttctactcatcatcctgagtctgaggtccacaggatggaacaggatttgtatttcaaatctgtctagactcctgtttctctctgggggccacgttgcttcctctctccagggtttcctccagtacccactctcatgtggtctcacctgtggcccgcctttcccatctgagcagtcacccccgaaggccttgctgggcctctgcacaccacctcccctcgcctttctactgcagccatgaggctgcctcttctgtgcctccttcctttccaacacagagacctcaaaggccatttcctccgccctgggctagtgccttcctttctgcagtggtcagcttctacctgcacttctgatctcagcatgatcagcctctcctgctggaagcactccctcaactctcagctgaggtcaaatttcagtttccctctcataagctcacagaatcatgtgcctcttagtaaagttcagcaccgttgcaatttttccaacacttgttttattccttttgtgctccacttaattttaaactcatgaagctgaaggctgagcttgttacattcaccaccagcagtgcctggcaggcagggagtcctcattcatttcacagagaatggatgagtgagtgacaggtgagtgagtgatgagtgggtgaatgaaccagtaacaggaacacactagattcattgtaccctggcagaggtctagagttaactttgcctgagatgctctgttatgagctcatcaaggagcactcacttgttgaacaagcataggaccatgcatggtgcaagccagtttgtcagtctgggaatttccaatttaaaatatgatgtgttcttcaagctgaatgagggtaaactttctgtatataattataatatctaagccatttcttaaagttttgggttaggaacaaaaaacccctgaagagggaacatttgtagatttaggatttttaaaatatatttatattattttcccttggaagaacaggatgggaacagccttatagttgctaatttgtggagaaggcatcatataaaagtaagagaaaatcagaattgtgttctagagggtaaattgtggctgtcctgagagcatgttccccaggaacctaaaccgtgagcatgttcaggaacccagagtgcaacagacaattcttggccccatgaatttggtggtaagactggagacagttggaaaaaccatggagtcttgaagttcttcactctcaatgcaggcctctcttgaacaccacagactaatgtcagataaatatgcttccactattaagactattaaaacaagaaccaatgaagagaagtgagcagaaacaataagcaattgaagtgtttgaagacaagaaatttttaccattaaaaggtatgaaagtttgtagaactatgtttaaaggaaattgaaatgtgaacaagaaaaaaagactgacagaaaccatcaagataacattaaaaaataatcaaattcaatacagaaatgattaagattatcactgaaaacaaaatggaaatgaagaaagatgaaatgcttctaagagattattagtgatgtcaaggacagagctgaagaagttacatagaatgcagcaccgaaaattaaatatgtaactttagaaagagcttaagggtggtttccagcatagtagaatatataatttttaattatatatatttatttatataaagttatttatatttatatatttaattatatatttattatataaaaatatataatataataatatagaatatagaatatatattctataatatagaatatagaatatatattatataatatagaatatagaatatatattatataatatagaatatagaatatattatatagaatatataaatatatatatttcccatttttcttatagataattgaagtttcagaaaaagaaagtagagggaataagtgattgtgatgagacattagctgagaattttccagaggtgtttcaggacctaaattctcaatttcaagaattcaaatgaatatgaaataagataaatgtttatattataatgagattgtggaacataagtgacaaatagatgattctaaaagctgtcaaaaagaaaagataaatctctcctagtggaatagactgaaaaaatcaatgaaagaaagaggatcagaaataaccatttagtcggaattataatccccattcattaaacactgagatggaggaaaatatatttacaagtggaaaaattaaaaaaaaagactatgagttttccaataaggtatcttttctgaattatagtcaacaaaggtgggaagtggtcccagaagaaaggcatgaggtgcagcttgtgagggaacccatgtgttgggacagccccgttgggcacgtgtgactgggggatggaggaggctggggcatcaatggggatggcataggggaccctgacttgcagaaaagacaatgagctcatcccttggtgccttgtgttgggggcgctgttggcacatcctagagaacatgcccagcagacagaggagcgcctgtgtggtgaggagataaactcagaaatgcagcatgaggcctgtagctccagacagctctagagcacaaagtgaagaccgatgcattgatgttgtttaaaaggagctaataaatatctaaagcagtcatccaagtgtgttctaatataaatcctgtgttcctgaggttgtggggattgagagaggaagtgatgtcactgtgggtactgttctgtgtcaggacaaggacgtccctcctcctctgctcctgctcacagtgaccctgatctggtaaagctcccatcctgccctgactctgtcatgggcaccaggctcctctgctgggcagccctgtgcctcctgggggcaggtgagtcctcagacaccaaccagtctcattctgtgtgtctgtatgtgtgtgtgtgtgtgtgatgagtacaactgttttcctcatcctgttctcaacttgtgtctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagcttaaccacagcatgacacaatcgcctccttcctgctcataaacctcctcctctctctccttgcttccttatgatactattttgcaccaggggatcctcatctcacaccactccactgcctcttccagaatcattgcttgcatgtccgctgctcagatcagcagatgtgcgttgtatatgttaatcattttctgtggaaggctcgttgctggtcttcattatccatccttattttccacattggatactgctcccttcaagattacttgttgcctacaagggatcctactttttacattcaaattttactttttattaatacgtatttgatgccatcttgaaggcaatctcattatcatcctaatcttttgctaatctttatgtttacggtaacattgattgttattttgggggacatgtatttcatctttggtaatgaaatgaaataactatgcacttcaattcctgtatgttctgcctacttaagagtaaatccaattttcttccattcctcccattctatcccactccctttatatgatagttttaagggagaaaatattaattagactctaactgcagctatgtgataagagttatttagaatgagggtgggatattaagctttgagtaaagcaatagtcagggttagaactagtgttggaatcagggtttagggaagttgctcataaaacctgcaggatgacacttctagaatagtctctcactcactctgcagacacttcccagcatcccttgggccattgcaaaagcaatgatgaaacttcacgtgttggccacaagatggcactgtggtccactgggatctaagggactctggggagagcctgggagagcagcctaggaagggaagggttaagaaaaattagggctggcatccaatattatgcagatgttgcagcagttttcagtcattgctaggctacctacagctatgcaagatgcaggaaatacctctaatctttaatgagatccacagttgaagaattttggcctggcagccttggtgtcaagcgcaggtgcaagcagaggagcaactgcctcaaaggaacgtgggaaagctaggggcgggctgtgccctaagctcagtatgtctctgctgcaccccatcttccctgcagacctcgccgggcaacagccttcatgagaggaggtggatcctgcctgagaccagtcagaaggccctggaccagctggactccgtaggcatggggggtgacaccacaggcccaccagactattccctagggagcagcctccaagccccagctcacagtcctgaggatcactgcacttagttgggccagcccctcctcactctgaccctaccatgaaccccaaactcttctgtgtgaccctttgtctcctgggagcagataagttctggaaacagctgcaaaaccctgtaatgggtttgcaatgtctgggctacaagccttttttgtcctttcctctgcagagtccccttatttcttaagtcttgtcttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagcacatccgcagccctgcacagccagctgccctctgcacaaaaagggcagtcacaggctggaggtgggcactccttatggaagcccgtgtctcaaccagaagaaaaagctgccctttctgaagctcttcccagacttcccagcaatgagatctcattctatgtgtgctcctgcagcataaaacttagagtgagctgggtctgtcactgtagtgcggatgtgtaaatgcaaacaacgtaatgttattttgctcaatttggaatattctggtaattgtgcaaaggaatggtagcttctaacaagaaattcatatttcactttcttttcaggagagaagaaaaaagcagaaagcagctgggaagctttagcctgcttgagtgatctgggattctcaagtagcatacataacatcaccttggctttggttcctttagataccaagcatgtgttctgtggaggacaagaaaatccatttttttttgttataaagttataaacacacaagagaacaatccagttagggagaatgttaataaatacaacaaactctgccattagacctgaagataatcagctagtagaattatcaaagagattgtaagactcttactgagtacctgtttgaggtcctctgaggatagatgaaggaaggaacttaattcttaccatcactgtggcttggattagaatccatgagttccttaacttgtttttcttgtaaaatattataaaataatatagaacacacattttattttcctgtagcctgtagtcctctttagcacctaaagggagaagcgcatatcccggtgcaaaagggagctggttgcttgcttggcaaaaaaatgaattcaccaattggccaatctgctgaaagtcaaaatgaaaggctaatatatgagactgatgacagttcatggttcttggtataacttcaacagcgagtgaacatttttttctttgtctatagctttctttcagccatcgatcctcagttgtgtcttagcctcttatcagtccagctcactttgatactaaatttgattgttgtgtatctcagcaagaagcacgtctcacattctctgtattttatgtggtcatgagtgtgttcctgtcttattcttattttatgtggtgcatttttaaataggactgtacagaatacaagcatctatttgtatatgactctcatcttttatggggagaggtcagagtaggtgagcgtgcactttgattctctgctggaatctctttggattctatgtcccctgtcacatggtttattttcatatgcatatttctcatggttctcctgactcttttagcaatgctcattgcaggatattagaaattgtattacttctaatggcagaatgttagaaattgtgttgactcttaaggcaaaataaaatacccggactcacctttccattgctgtgtctattagtcgtggtcctggagatatcaaggagggacaaaaggagtatttgcaaaggtgtggcagggttaagggaacccagtaagagaagtagaagtagcctaagaacagcagaatctgtggctcttattcacattggcctgaaataagtaggagaggatgtggatcccaaagcatcaggtactgtagctctaaggcaaggctgcctataaggtgctgtggactttggtagggaaaagtaacctatataaaataatgaagcaagaggagagccagggcatagatgaatcagaacaagtggtgcccctacctccctctactctcctgccattgtctcccattagccaaactcactctggagttagagaagaagagagccagttaacataatacactgaggtcagcctctgaaggcagggtggatctggagaaattaacgtaaattatccagatcactacgcataagatggccttgagggtgctgaatcccaaactgtctggctaggtctgtgctgtgagctgataaagccctagtgttatttctggggaatctgtactcttaataatttacagacaaccaaggtctgctttggatctgatcagatagactaaatcttggggactttgcaccactggccactcaagggaggggctggaaatattttctgaggacaaaaaaatagaattagaaaatttggttgaatctagcgtcagagagatgacattaggacagccagggagagctggaacaagaaggtttaatcacaggctcctcaccctctgctgatgggcaggtgtgtgagctccagcatggagcacgacagcactaggtgggaggagggtgagagggtgatggggcagcctgggagctggagcagtgtaggcagaggagcaactgtctcatcacagaagcttctgccctcacccaacccttctgctggacagggagggagttcaggttgtggggagtactggacctcaggaagcatttatagggaggacacaggacagtgacatcacaggatatcccacccatcaggaaaatcaaggcccagaactcacttggcccttccccaggaggaccaagccctgaatcagatgcagtgctgcctgccccactgtgccatgggccccgggctcctctgctgggaactgctttatctcctgggagcagatgagtcctgtgcacagaacagcagccccattctcagatttcccacccctgtgtcctccactttacactggggaggacctccaggctgtctgctgtgctcatcctccatctgcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaagcttggcacagccctgcagagtcactggaactctgtgcactaatctctctgcttccgtgtacagcagtctcagaccagacagctgtgagaacctggggccttcagggggaaagataaacaatttcaggactctgaacaaggctggcggaaacaaggccaggaggatatgctcagaggatggtgctgcttcaggaggttcacggcaaaattactttctttgtcggatgctgtacactatagtgatagagtagctggcactctcctttttagaaaaagaaattcattttggtgtcaggattgttcgacagatgtgtagtatagaaggtaaaatctcaagggtttgctttatataattaagggagaagaaattgagatttggtttggagaaacttgaggagagagaacatgattaaagattattaaataaatagaagtagagctaccagatgataaaaaattgtgttctctgcaacataacctgtcaaagttttcaattgctagaaaatacgcagcaaggccttgtagcaactggcatcaccccgaggccactctatgatggtcatcaccacgtagccagttgccctgtgggagggccctggagctggttccaatgtcttccttctggacttatatctcaattctcaaaacagaggaattcatttcactgctgatggtaaacagataaaggctctcccatttccccaaagatacattctgcttcccttgtatctctttctgacacttaccgcccagatccattaccttctgtgatcaaacacctcttcgaatatttcctaaaactctgcagcctttacattctctgcatttgtgctcagtatttccatggcctggaaggaccttctgtctcccaagaaacagccagaccctgcttatcggtcaaggatgggctcacacctgcttcctctttgcttcttaccatgacattccccagcattgtactataccaccatctttattattttcataggaaaagccaagtattaattaaatatataatgaatattatttgatgttgtgaaatctatgttaattcctgcttatatagagttctggaatattattacttttattcatgtgagggatattattaaccactaactatttcctggttagagatcaaagtcacttctgtgtaatgatagcaaatgtgagaaccagctgaatctgtttgaattacagctggcagtattattcatttcaaaatttttataatttagaagtaaatttttaaaatctagaaatccttttgtgaaatgcactgtctaaaatttagtaataatgaacctaaatacaaaatatgaaaacatatgggtgtaattaactgggattagctgtggaatatagggtttccaggctgggtttccttgatagcatcacactgtttaattgtatggcctttataattctggctggtctctaccatcttaacatattatttgcaattatgtaacaattgtttattttgtaatcaaaatgttggttcatgtgtcctttgactccattggctaagggtagatttgaaaatcaaccctaaattgactcttctgggaaagcatggacggggtgtgtaagagggtgggagtggcaggagtgggggcatctctctttctgatttggacaatttgagcatatcacgtcagagggtatgaatccatgagactgtagactgttggccacttggaggcgctgtggctccacagtgctgcagagaactcagcggaggggtgggagagtggccaagagaggaggactgaaggggatgccctggctgcctgctggcatcagtagagtggatggaattccctgagtggggcctggccatgtagagttaagcacagactatcattgccttgaaagagttggggtgccagaggcctcagtttgcatcaaggagggagtgtctctgctgctgcacgggcagtggagggtgaaggggctggggtggcaagggctggggaatcagtgtcagggcagggacagggcgggcagaggaaagtaaggtgtgatgtgggtatgttggtactgtgttcagtcctcctcacctttagcttctggcctgtgcaagacaggaatagtacatggagtagcagaacctgaggcctgccaaagagtacagtgggctggagtggcctgcaggggaaagtatgtcagtgtggtgacatcacaggtcaatgctcctatcaggaagaagggagcttaggaacttcagaatgcttactacagagacaccagccccaagctaggagatcctgccatgggcttcaggctcctctgctgtgtggccttttgtctcctgggagcaggtgagtcctgggcacaacttgaaagtctccgatcttcatttcttgtccctgaaatgcatgtgggccaacgatggcttcagcaggaggctttcttctgtgccttatggttaacttttgtcttctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagcgtagcacagccctgcatgagcatcagccttctgtgcaataacattcctgccccactcaggaagtgacggtgaggggagggctgccagccagaggggctcaggccctggagagtggacaggcctttcccaggcactctctggtgcttctgtatgtgatctggtttactgctcactgaagctgtgtaagcgaaatattattttacctgtttatatatctgagggacagcagatgtcctggggctcatatttagtagctagctgaagtctattgtttcaacacctctgcactgtccctcctcactccggagatctgtccttttacctggtgtcccctttttgtgtccccaagagcaggatgctaaggtcatatatgaaactgtgatcatgataacttgttccctgacaagtccaatggacacatgatttccaggcaaaacatatccatctattctttattgtgatttaaaaaaaaaagaaagaaaagaaaggtgcagttttctgctctgtagccctcctatgggcaaggccaggtcatctcttttatggagactgtatgaggagggagctttcctaggttcacagcaaatagcaggaaacgttttttatggggcgtgtagtcttcctgtggcggatgcaatctgccatcagtgaaaggacatgaaaaattgttattcattagttaatattttttattcttttttttttttgagacagagtttcactcttgttgcccaggctggagtgcagtggtgctatcttggctcactgcaacctccacctcttgggttcaagagattctcctgccttagcctcccaggtggcctccaccacacctggccagttttgtgtttttagtagaggtggggtttctctttggtggccaggctggtctcaaactcccaatctcaggtgatcacctgccttggcttcccaacgtgctgggattatagagccattgcactaggccaattttttattctttatcaataaatcttttggggcatcctactttgtacaagggattatatcacatgaaatatacaatgaaaaaagataattggaaaaaagggaaattttttaaaaatgaagaaaagggtgtttcttgcatttgagggtatcaaagtctgtaatttttggtatattctaattagtttactcagtttctgatttatacgaatttcctctttcttctctttctctctttggctacctacacacttttgccagattttttaaagtttttagtaacaatatttaacatgagatctaccctttttatagacttataagcacacaatacagttttatactctgtagtcataacgttgtacagcagatctctagatcttattcatcttgcatgattgaaattttatacccattggcagcaactccccatttaccccattccccagaccctgaccgctaccattctagtctttgcttccatgagttggactattttagataactcatgtaaatgacattatgcagatttttgtctttttgtgattggcttatctcatttagcctaatgtcctaccaagtatagtggtgacagttttacttctatcttccacagttcactcgaatagctccttgaccaactgtaacccagaatcataaagataaaggcattcttagaaatataacttcttgtcctggctaagttaacttaacacaacccggtacgggatggattctcccaggttgaggcatctggtcacatacgagtttcaacctatcatggtctccaggatccatttttggcggcaccactgctgcccaggtgactgtggacacaacttagatgtctctgtcctagattttccaggccccagctactggcttttcttttaacctgtgccggcagtctccctccactcagacgcagggatctgcctcctgctcccatctccttcctgaacttccgccctgctggagttgcatggatatcagggcccctggtcaatgtgcggcagcccacggaggcactgggagggaagctcacctctagctgccttctggggcccagttctgttataccccaagcaagtgctctgttctccctttgggctccacagtatgagaaatgcacttcatggattcatagctgacccctagctcagtaatctgatgacaaactttgagtttcactcaaagtgaaactctcagagctgagggactagctctgcatttctctgatgagggtaagaatacagtgctgtagagatgccttcttccctgtgtagacctggcactaaacaggaaaaaccagacagggtaaaagtgcccaaatatgtctgagaagactgaaagaaaatttcctaagaaaatccttctcctgacttcattcagttcctagtaagacacacctcaccctctgacccccatatcagctggtccccccaggatatcacacgtcctagtatctaaccccacagcaactaattcagatactggcctctttccaacctccagaaacggtcttgccaatagagttttgttggccgggcgtggtggctcacgcctgtaatcccagcactttgggagcccgaggtctggtctggtcacctgaggtcaggagttccagaccagcctggccaacatattgtgaaactccgttccttccaaaaaaaaaaaattacaaaaattagctggtcatggtggcacatacctgtgggaagctgaggcaggagaattgcttaaacccaggaggcagaggttgctgtgagctgagatctcatcactgcacactccagcctgggcaacagagcaagactccatctcttaaaaaaaaaaaaaaaagagttttgtcctctgaccaccaggtctatctagatatctaggcagatttaatttacgattaatttgacctcttaatcccattaaagggagaatgaagagcgtatggtttcaatgtaaagtatattcattttattttgaatgagttggaactaagtagtaaactgaggatatcactccattatagtcttaaaacaacccatggtaaaacaaatctctttactaggactttctttttcacattttagttcctagttacccagagtccagaatagttaagagttgaagagtcatgactgagatggtctgtgggggtttataaatgagcattcacttgttgaacaagcctagggccactctctatggaagcagtttgtcagctggtttgggaatttttaatttaaaatatggtacgttctttatcttgtataagtataaagtctacaaatataatttgcatatataggctagtgcctgaagatttgggtaggacaaaaaggaaagaagagataatatttgcagatttaggaagtttcattatataaaacttcaagggctcaggggctctaatttgtgaagatagtataatgaagaagaattagaaaatcagaactctcttctggagcctacactggggttgtcctgagaaaagattatgatatgaggaacataatccatggtgtgcttagcagcccagagtgtagcagacagttcttgactcatgcagttgggggggtgagactggagacacttgtggaaggtactggctgttgaggctgtgctatagcctctccaaaaccccatagatgaatgtcagacaaatatactgccactatgaagaatattaaaagttagcagaattcataaacactcgcaataggcagcctgaaggtttaaattttagcatcatgacatatgacagtttgaagagctgtagttaaatgcacacaaaagagaattgaaacctgaacaagaaaaaagagactctcagaaatcattagataacttttttaaaagcattgaatgggatgtctagaaatgatccctaaaatgactgaaagaaagcagataaattgaagagcagattaaatgctcattgaagagattattattgacttcaaagacaaatcttaagaagttacccaaaacaacacaaaaaattaaatgtataatatgaaacagagaggaagcaacagagaagaaacaatggaggtttcagttatattcgaatatatgtaacatttcataagaattttccatttattcttatgtcattgaagtgtcagagaaagaaaataaggagaatgatatgaggtgatattgtgtgtgatgctagctgagaaatttccagagacatctaaagacctaaaacgtgagtttcaagaattcagataaatcccaggttaaatagttacctcagtgttaaaatagaagaatatgaatgatgaagacacaatttttcaagcagtccaagaaagacaaatatctcgcaaaggaatagactgagaccgacaggaacagtgaagaaagggagttaaaaatatctataaatgcagattatagtcctcattcatcaaagagacaaggagacctcggcagttcatattctgaccccttgggctggtgacctgaaatatatttggctgagtgttctcatttgtaaaccgaattcaatttgcagagatttttttttttttttttggaaatagagtctcgctctgtcgccaggctggaattcagtggcgcgatctcagctcactgcaacctccgcctcctgggttcaagcaattctcctgccttagcctcccgagtagctgggactaaaggcacacacaaccaagcccagctaatgtttgtatttttagtagagatggggtttcaccatgttggccagtctggcagagatttgagagaggtaactttaaaaattagagtcatataaagtgtaggttcaagaaatcttaggtccctataaattctctgacaaatctccaatctagcacagttatttactctctgaaattctggtaacaaagacaagcacagattacttttgcctgattcaatcatgtttcagacacaaagtcatctaaaatgcaaatatagtagtctgatagttcattatgtaaaattaacataaagagttgccgtttaaggaaatatgcaaatgttacctcttatgaacttcctgcttgataactgagtctgatgtgcatgaaggtgtggtgctcctagaaagatatggcttcagtgcaattgtccatcacacaagagagctgatagaagaaggcacagctttattggaaagaagaccacagaggagcctctagtggcttccatgacatcctctccgcccacctctgatttcagccttgctgctgtggacggtgccagttcccattcacctcttgctgacagtgcccttctgcagtgcctgcttggaatgttgctgcttcctgctctggggtcttctctggtatctgaatccacttgggctgtattcaaagacagccagaggtcctgatgctcctggtggaacaggacagggggacaaaagctccaacctgcccattcatgcagatactccagagagcaccctatgctcttggaggtcctgatggattccgtctcctgttgccccagcacaaatacaatattgcacctttatcctggtttctcccttccctattttgttttccttgctctcttacttcttcctggaatcatttcccaaataagctacatgcacccaagtctccccatcacagactttgtcttcagagacagactaaactgtggcagtgatggaatgaagcgaccatcaaaagaccctaccttttgaaggagacaactgtttatcttttattcatatggctacccattcatttaaaaagtcttatgatgatgtatataaactaatcttttccaaatccatttggattcatctggaattcccagcgttctcaggatggctctctgctcccttaaaacttcaaacctattttgaactgaataaacttggattctgtttacagaagtagaatctgcctggactcagataatcattcattcctttcttcattcaataaatatttaatgaattataggtgaagattagattcaagttttgtggcgcacaaagctgatacattttaggtagctctttgcaaaagagagtgcaaaatagcaaagagttgaaaagaccctgtgcaagtgagaaggcctgaggttattcttcatcggcttcatggcaaatacacaggtactgtccaggtacttgggaaacaccagtgcaaaaaacagacaaagcttcaagttgaggtagacaattttaacacataattgttataatttattatacttaataataaattaatttaaaagtagaaggatatattcctggtagatgcttatctccccggagaagttagagtgtcattgagaatatcaacattcttggtaaatcatacctgatttagggaatgatccttggagctctggaattctacatgccttaccttgcaaaatgaaggtcctgatctgaaaagttttttttttttttttttttttttttatgccctggcccaaccatgaggattggcttctttgctgtgtggctcttggtctcccaggatcaggtgagttctgggcatagatgagaaagtccttcctgggcttgtcgggccccaaccacggcctcctatgggggtgctcatgggcctcctccctgtctccacttctgattctgtgtcctctctcactggagcatgattgtgggaattacccatccaggttgcatcaagatgtgcaatagatagcctattgtatctgaaataactattgcagtgttatggactacatgtgagttttgcaccatagcacgtttacaaatccatcaaccttctcccatttggtgaatataagatctgctggatgggaatagaggattttcctgtgaccctagagactccaggtaggtgtagttcttggtgaacatttcatccatattcctaatgagcctcctcttttcttcacaggaagtacagtcactcaggggacttagatggggcagtgtttgtggcttcacctgaagcaaagggagaaaacacccccatgagaatacacagcagcctgagcttggatggtgacattcccatcaggtgtaatgaggtgctacagcatgtaacaagtcttcaagcggtcatgaccttgaacctggaacttggaacttggagacatttctggatgtcatttaaccgagggtatccctgtatgctggcatacaagtgtccagaggttaaacgaagaggaaaataattcaacttggagttgaattttgtgcaggaagtcataaaagtcaccaggactgctatgacaatgttctttagcctacagaaatattcataaaagtgaaaatagtattcaaataaagaatttctcatgatggaaataaaatatacatagaagaacaaattcccctattaaaatcagggaaagagcttaggagtttattagatttctttcaaaacagacctaaaaattattcaactctgttataaataatttgttcctgcggggaagagaaggggcatggcaggttagctccgcagttcaagcattcagcaggaacagtgacatcatcaagtcactgagagcccaacttcagtctgcccacagcagggctgggagacacaagatcctgccctggagctgaaatgggcacgaggctcttcttctatgtggccctttgtctgctgtgggcaggtgagggctggtcacaggagggcctccttccctggaattcccaaggcctcagtgcaggcttttctgttgggatgacagcatcagcatctgttgttctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgagtccacagtgctgcacagctgcctcctctctgcacataaagggcagttagaatgactgaggttgcctgtgctcccaagtcccagccttcacaggagtcggagagccctggctagcctgggggccatagagcaggggccatataaaccttgatgttgaggtccattcctaccccagtctcagaccaactggaggtcaccccaacacccttagcttctgcagttccctctttccttttgtaaaatggaaaaggcatctttagtcgagattcctaatttcgttgaaaatttgaaacccaccatattcttctctaccctaagggctgggtgacttttccacataccctttcccctaccctctactgcctttcaactcccaatcataaatctttgcccatgtggtctctgctcctgggggccctttattctaagggcaatagacccacgaggtcctatatcattagccatttacgtacctcttcatcatcattttgcaccatgttttccctggctctctgctccagccacactcccttacatgcagttatttcttcatatgtgtctgttgttttccaccctggggattgtttatataaattctttcttctgcactgagcatacataccacccacttagtcctacatctctacttcatttcttaaattaaagtgtatttcaggcacacttgctcttaattgtaaaaagcaaaaaagaaagtttactagaaaaatttaagaaaagcattttatgcattcagttgagggatgacatttttagaggagacaaaaagccacaagccaaaagaacaacattcataacgctagttgcattaaattgtttcaagccaaaacacaccataaaaaataaagttaagctacagcctgggaaaggcatgaggaatgcatacaaatgatgaaaaatcagtgtgacagagaacattcagtgtaacagagaacattcagaacatcactgaatacctgtagctcctccatggtttctggtctcccttgcagttggaggggtgggaacatgtcaccaggttctgaatagtgggataaaatgatgtcagctcatttcaagcctggcccttaaaaatattctgtggcaccatgttgagggtctctaaatgtactcccatgtttagagtgttggtatatggcatagagttgtactcatggctaagatttattaaagtgtcatagtaaatactctgcagcagaacatgtggagaaaacacacaggcagaatctggaggaattcacaggcaggcttccttatgctctcttcctctcaggaggggtcacacagagctctctctcctcccagcagcaaaaatgcattaacacacgtgcagtgtatctgccaagggagcccattacagacttagcacccaagaggttttagtagaagctggtcacacaggcacctactttttagcatgaaccaaaagtctagatcccaaaagaaaatctgatgttcagcataatattatttgcaacaccagcctaggaacgatgagccacccctgtcagtcaggagaaactttgcatcagttcagggcaccgttcaccagccaagctcccagatgtctgccagagtccaatcttgcaagcaggactttctaagcaccgcagtctccagcctcctgtcaactcttgtgcacagacactcttcaactctcttttgccatgtcctgaactcgggagctacacggtacagattgcctaatgataatatggaagcagcctggctcactgagtcagaatttggtggacaatcacagaagaaagctgctcatgccacactgggctttgtggtcatgggaagtaagacttcatagagctatgccagtgagattttaggatttgttttgtttgttttgttttctgtagcacagctgttcttgtctaagagaattagtatctagaatgagtaaaatattcttattacttagtattaagaagacagctcaataaaaatagcaatactgaggctgagtaggcaattcacacaagagtgaacataagttaccactaaacatgagaataacttcgcaaccttacttacaatcagaatattgcaacctgaaacagtaagttatgatttcaaaattactagattggatacttttccaaggaatgacagtcctacatttgagtagacatatgggctggtgaaaattgtttgtatatttattacaaaagataattacaactacatcagaaaacccactgtgggatatattgtgacaaaccacatttctggaaaatttatcaacgtatttaaatcacttgggttcctttcattgtctttaagttcaataatggagaatgcaactgtcagtgtttttcctattttgaaggtagtctttccatcttttaaaaagtatgataaaatgcacgtaacatataatttcatcactttattttttaaatgtacaattcaatgacattaagtacattcaccttgttgtggaattatcagcattatccatttccaaaattattttcatcaccccaaacagaaaccctgtacccattaagaaataacttcacattctccctcctctggcaaactctaatctattttgtatatgaacgaatttgcctattttagataatgaatttacatgaaaccaggcactatttttccttttgtttctggcttctttcacttagcataacgctttccaggtgtatccacattgtagcatttattagaacttcattctttttcattctcaataatattccattgtgtgtatataacacatttgtttattcattcattagtcaattgacatttgggtggtttccaccttgtagatattgagaacaatggtgcagtcaagactggcctggaaatatctgtttgattccttgttttcaattcttttgggtctatacctaggagtggaacttctgggtcctttggtaattctgtttctcgttttgagtaactaccaaaatatttctttgttgcagctgcacgattttggatttccaccagcagtgtccagtttcttcacaacatttccagaacttgttatttccttttctttttcttttttcttttcaaaaatatgatgatgatgattactgtttttatagccatcctagtaagtgtgaatgatatctcattgcggttttgatttgcatttccctaatgactaaagatgttaagtgtcttttcttgtgcctatgggcaatttgcataccttctttgaaggtaatatttattttatttgattgtgtttttagagtcgctattgactttagatttaagctggtgtacctgtgatgatactaaaggaaattgagattgagattaaacttctcttgggcgatttgttgttggctaagtgtttttaggtgcagtacttctgagacattttgggatactgtagagagagaaataagtaatttattgatatttctgggaattagattttttttacaaagagaagagagatataaataagaaacgggaagatgaggaagaaatctgtggtgctgacttgaattggagttattaatgcaaacttaaggttttaaagattatatatttcctaactttatccagagaagggtctaaaaaacaatacaaagtaaataaacgaatggctatatttgcttttttttgtgctccccagtaacaataggtacattattttattccaaatgttattccttataaaaggctgcttccatatcaagggaaggaaaagtgttagaacatcttttggtagaaatcaagaaaaaggtcagaaccaagaagacatgtccaaaatccacagaagcaatttcaaggggctccattagccaaatccgggtcaatgcaagctttaaagaagaataatgaggatactgaattgtaacaagttataaaaatctataaggctataatgacaatcaaaagagatagataagaatctcttcattacggaagaatgctagttgatatatctaatgagaaaatcaatgcaaccatccacataattatagacaaattccattagtagatgcctaaactaacagtttttgtttccttcaatactttgagttatactgttctactctctcctggcctgttgggtttctgctgagaaatctgctgaaggccatactggggctcctttaaatgtgatatgtttctcactgcatgctgcttttagtattctttctttgtctttgatttttggtaatttgattatattgtgtcttggtgaactcctttttgggttgaatttgattggcagcctccaagcttcctgcacctggatgttgctgtctttcctcagatttgggaaattttcaaccattatttccttatatatgtttttggggcctaacagcatatgtaccttgtttcaaagcatcaatacacagattattacttaattacaaagggtaaagggcacattcacaatggagagatcttggatcagtcatctcaaattaagcattgccaaaatgcataaaaatgacattccatattcttgtgattgaccagatgcaatgggaaatagacatcatctatggtgtatattttccaagtaattaacctctaataatatgaaaatttttatcgtgagctgttttacaagtaagctgaccaggacacttcaaaaatctatggtcatgaaaaacagaaaatataataagtgggtggaggagatgtatcattgaaaagtaactaaagagatccgacaacttcctgaaatacatgatctttgatattgtcccagaggaaaaagtaaatcaaaaccaagggacatggttttggtggggacaaaccacggccaaaccgcaggcggggctctggcaagacagtaggaatagatggagttgggaggaactccccccagtgccgcgcaaacactgtccaatattagccctgattctactgaggacagtgtagacatggccccagtatttctgacccatgaatggagggcctgagcctggtaactctgaaccattcattgaccagcaggcggcactagggtttgctggggttggcttgcttttaaatcagggctcagtgctgtctgaggagttaagtttaaaggaaaagtgtgacttcatcccagcatccagaatctagtttgcagatgtttgagtgtcctgtggaatgtgagccattaaacagaaactcttcatcttccagcaatgccagtatcctctgttcagcagggaaaccccaactgtagcaaatcattgagtgaataatgttctgggcttgcatcagggatagatggaggagagccaggagccagcctgcatgctcacagacccatataaagggagaaccacttcctcctcaggagaactcagagaaaccttagcaattcacctgtaccccacacctaacccattccagttgtgccctggatggtggacaggaggatgtaaagggaacataggagaggggagtggacaattccagacctctccagataggcttagctcaaataaccttgcaaatattctgaataagagccagatttcccagggctctggccttttcttccctgagcagcatgatgatgctccattcctgtcttgacaaggattctgtcatggatttcttggttgtgctgcccaggaagcaggtgaggcccaggaacaatgaggaatgtcgtccctggacttggcatgcctcactcgcaagcacaccatatgtgggtcctgtgattgataggtttgatagatggatacgtcctgtttccagccaccagcctctatcccctgaatgctgttgtcaactcagagccacaactctggtcacaaagatggagcaggtagtggcaccttaatgtgaagaaagtttccatcatgcaattgttacctggtgcctacatgagttagactcaaaccagcagctgtttacctcagtgatagaggatttatgacagaaacagagggctcttgtaattctatacccacaggtattcacctgataaccttcacatgtgtcccctaggttttggggactttgagcctgcctcactgaacacatatatcctcgttcccagctctctggacatgcatctccttgtattattgtcttatgccaactctcaggtgcttcatcccctaactcttcccatcctttaccccttaggcaatgaataaaagtatatttgtgactaatgttgccccattagaaaaaaaatgccagatactagccactgctgttcaattgtaacttatactaaatctgtaaggtttttttttttttaagatttcaacaaatctgattttagatttcttttttcttttgttttgttttttgagacggagtcttgctctgtcgcccaggctggagtgcagtggcgcgatctcggctcactgcaagctccacctcccgggttcacgccattctcctgcctcagtctccagagtagctgggactataggcatgtgccgccatgcccggctaattttttgtatttttagtagagacggggtttcaccgtgttacccaggatggtctcgatctcctgacctcgtgatccacccaccttggcctcccaaagtgctgggactacaggcgtgagccaccatacccggccgattttggatctcttactgtattcacaatgatattttcagggataagagagtccccacccatcttataagatatcagaactttcattacattgatgaccaagaaccataggcagaaccatgatgaagacttggtacacaatgcatcatgaagcttgataacagaaaagagaaagctggccattgaccttcaccaaaaatgaacccttccaactctctctcagggtattattttacccctttagcttagagcatgtcagctggttcaacatgcttctaggataaacctgtgtcaactaccccagctcccactctgtctaagctcatagcaatgagaaaatggagaacctggtaagacagaaatgcccagagagaaggatatacagataagacatagaggttactaattgttgtctgtattttgagttgcctttgacacattcaagtagaaacatgcagcagaagatggccctggagatgcagtgggtgatccaatcccccaagccctagagatgtgagtaaagacacttggatgaacttacacacagtccatgaatacgctaaagcaacttctagctctgttttagttcataacaactggtttctaagaacttaggcacttgtggagacaatgatgttactgtaggaactaccgtataaggacaggatgtcccacctcctctgctcctgttcacaaggaccctgaactggcaaagctcccatcctgccctgaccctgccatgagcaccaggcttctctgctggatggccctctgtctcctgggggcaggtgtgtcctaagaacaccatgatcatcccattggaaattccagtgatttcttcaatcatttctgtctttctgttttcaaattctgtctttttccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagcttagccacagcgttgcagagactttctctcctgtgcacaaaactccagggctctctccgctctactcagctcacagcagcctttccttattcctcatcctctcagggaagaagtgagttttcagatatagctagggttcatatagtgggaggaaatgaactattttcttaaaacatgagcgctatagttgttggttgaaaacatgtcttagggatttgaaacacttctgggtgggaattcaagaaaccaaaactgaaagtgatttatcccagacctagtcctcaggggcagtgatggttgttcttctataaaaaatgcacacaatgttgtacgttaattaagaaaataaataaataaacttgaaaaataaaaacatttaatcaccaaaacgtgtgttaaactttaataatatagatattgattacatgcaagtgacaaacagcaggccctccttctgccgttgtcagcatctgaatgatgtgaatcttatctggctctggagcctcttcttgacctctcactggatgtttcatgcagtcaaatctcaacagacactgtgtgtttggaaatcttttccctctgtttttgtggaaatatgacaataataataatattgtaatgatgatgatgttgatcatttcagctatttcattcagcacactttaaacttcaaagaaatgcacacaaatggttatcctggaaacaattcccaaatcttaactcaaaatgaattttgcttctctggagtgctttaacttttcagtgtaacagacacagcccaacactataattaggcctgggccagctagttcagaggctggtgaagacacttccacctgcctgcctacttccttgtctgcccactaaaatagctccttagtgcattagatattcctgccagaacttcagaagcaatgaactgcccctggtccagttgtctcctctgataatgcactgtgtgtgtccaactctagtctctaccctaacttctgcccagattctcctgtactagaactcattctgaagtactggttagaatgtttgggaaggcagcttcctgggaatcctccgaaggaccatggctgtcagtgattccctcgtaacacttcttgagagcatcttgtatttcattgaacgtaggactcccatttatttcagtctgtctgctcctgttcacctctgagatctctgtggcttgtttgtgttgatttccttttgtgctgcttcttggtcatttgttcgtatttttccttataaacctgattatttttgacatcgtgccagacactatggttgtagaaataatttttggtctaggatggacatatctttctccagagataattttattgtgttttgtaaagtgcatggatacataaacaatccaggactccctgaaaaagaattaaaggcttgaggtgtcctggagcccctggagaacaggtttcctactagttccttgtttcaattcaagttcctcagtggtcaccctcagtaagttctggtcttagccattaccccccagcctgtgaatcagcttcctgagagctgggctgggatcagcaaatgcccctaagggcagtgactgctgtgttcactcccccaggctcctgccttctccaagattctggaccagttgtccctcataatgtttttgggatattaattagtttcagtttttgttagtgtggtaatttacccaactatttaaataataacagaagggttaattttgttacaagaaaggggtcctgatccaaccgccaagagagggttcttggatctcatgcaagaaagaattcagggtgattccacagtgaaaagccaaagcaagtttattaagaaagtaacatggtgaaagaacagctactccacagacagagtagggctttcccaaaagtaacaggaggagcgcatctaccctacgtacaatacttgtttatatataggataagaaaagatcgttgagagatgtgctctgctacaagggtttgtgataaaggattaactttcttaattactatgttttgcaagaatcagtattattatctttaaagagaaattaggaatgtttctgttctcaagatattggggtatcatgacactcccaagtctgggtctgtttagtaaacattattaatctgttgctttaaccataaacatctagaggttagggatacctgattttctgggaatgcagcccagcaaggcccagcctcattttttcacttaagatggagtcactctggtttgaacgcctctgacaatttgagtttcctcttctgtaattactcagatgaaggtcaaagaatttcatttaaagttttaattttctttgaatttcaatgtctgattcttagtctgtgatttgcttgatatttaacttaaatagcatagagaaatgttttactaaaactttaatttcgaggaaaggacttttttaaaaacttgaaggggatttataatcaaattgggacactcacttggttttgacattttatcatttagagtattattatgttgttaattacataaccttcgatgcttcattcgaacagggtaatgagaatagagagtaaatatttaaacttcatcagatctttgacacacctgacaaaaacaagcaatggggaaaggattccctatttaataaatggtgctgggaaaactggctagctatatgcggaaaactgaaactggaccctttcgttacaccttacacaaaaattaactcaagatggattaaatacttaaaagtaagacctaaaaccataaaaaccctagaagaaaacctaggcaataccattcaggacatagacatgggcaaagacttcatgactaaaacaccaaaagcaattgcaacaaaagccaaaatggacaaatgggatctaattaaactgaagagcttctgcacagcaaaagaaactatcatcagagtgaacaggcaacctacagaatgggagaaaatttttgcaatctatccatctgacaaagggctaatatccagaatctacaaggaacttaaacaaatttacaagaaaaaacaaagaaccccataaaaagggggcgaaggatatgaacagacgcttctcaaaggaagacatttatgctgccaacaaacatatgaaaaaaagctcatcatcactggtcattagagaaaggcaaatcaaaatcacaattagataccatcctatgccagttagaatggcgatcattaaaaagtcaggaaacaacagatgctggagaggatgtggagaaataggaacgcttttacactgatggtgggagtgtaaattagttcaaccattgtggaagacagtgcgacgattcctcagggacctagaaccagaaataccatttgacccagcaatcccattactgggtgtatatacccaaaagattataaatcattctactataaagacacatgcacatgtatgtttattgcagcactcttcacaatagcaaagactcgaaaccaacccaaatgcctatcaatgatagcctggataaaggaaatatggtacatatacaccatggaatactatgcagccataaaaaagaatgagttcatgtcctttgcagggacatggatgaagctggaaatcatcactctcagcaaactaacacaggagcagaaaaccaaacaccgcatgttctcattcatacggaggagctgaacaatgagagcatatgggcacagggaggggaacatcacacaccagggcctgttggggcgggggggtcaaggggagggatagcataaggagaaatacctaatgcagatgacgggttgatgggtgcagcaaaccaccatggcacatgtatacctatataacaaacctgcatgttctgcacacgtatcccagaacttaaagtataataaaaataaataaataaaataaagttgatcagagagcagagagtgaacatggaatttacttcattcctgcactgtcgtgactcatttgtgccatgttttgtgagcacacctgaggggcaggggtcagaattggagggagtcacaggtgtgtggctatcatcttttccttcccagtcccctggaaaggtgcttggttccacattttccatttgggggaacttccctaaagtgatacactggtttttgtctattatttgccaaatgtttcttatgggaagtgaaataagttatcttatttagtctcctcttcatctgaggttagtctctcttcatcatcatcctttcatcctggctactgagaaaaaaaagtagattcttttggtgctttttcaacatacactaagatcagtggagaactttctttccttacagggttggcctgtagtttgcaggggagagagaatggattaaattctgatacagaatagtgtgggttggcctatttgctctcctatctgagcactattagttattaacactgatattttatctccacttgtctgacttcaatgtccacctctcaggtggttccatcttaggccatagcaacattaagattgctttctgaccttctaacaccaacaaatcataattcccatatctccatgactcaacaaagcaaagcacaagtcccctgtgtcctggcaagagagcagatttgtgctgtttctgcctactggccacaaggaggcactgtggctttgttgtcatcagagtcaaatggggaggggcgaagatggctctctggaagattcttaagggaaaccctgggtttggccctagattcagggagctgggctgtctggaatgaaggctgggaatgaaggaattagagaccaaccaatttgcctgtattgttgtggagaagggttttgctctaaactgagctctgaatggggctgagtggcaggtgtgcttgcagtggatatatgtctgagcgcccttaagatgtggaggcacaagtagctggggtggtgcagtgcccaggttctgggctgggaaagcagagaagcagttttcatgttacaggagccttggagagcctggccccaaacccccaaaccagctcaggccagccctacctgctctgttaaaagtagaaggaagagcagggagagacggaggtgctaccctggaccatcggagggaccctgttccccagtgagggggcaatcacaattacaacaccagtagcatatacacttattaggcagacactagggtggagtagaacagagttttctccaccaagaccttttgctctcagcaggaaaatggcccagtctattaatagttcacctctgctactcacttcagactcctgtgtgtcccctggaagaaggtggggtctgggtagagatagtatcttttcttttggtttgaattaaagttctttccatatgactcgttcatttgcctctacctgtatcttgtatctagcttctgcctcttgtattcatgtgtgccttggacactataaagtatttgatttctactgctgctgtaatgaattaccactgattttggaggtttaaacaaaatacatttgctaccctacaatactggaggccaggagtccaaaatcagtgtaactgggccaaaatcaaggtgttggcaggcctgcgttctttcccagagctctaggggagaactgtttttctccccttttcagcttctagaggctaccagcgtgtcttggcttgttaccccattcaatcttcgaaaccaacagggactgactgagcctttgctcatgctgcatcactctgacactctttgtcctccctcttccacattttaggacccttgtgactacattggacccgcctggaaaatccaggacactctcccagtatgaaggtcagctgattgacaacctgactttgtgtggaactttaatttttcttttacaagtaacttaacacattcctaggttccagagattagacctggacgtggttggagggcctttgttctgcctaccaaacctaggaacttggtaagagggaggaaaacaaaatgatcacctggaaaccagaatactgaccaccgttttacatcccaggcctaacagacacaaaaagggatggagcccacaaggaaatagacacctcaggtctcacaagctcgtctgtaaactatttgctccttaggatcggaaagtactctggggtgcaggggactcagcagtatgcctctgtgccagcagcaaaaatgtggccctaaactgctccttcttggttagcaattaacccagttgaccaacccacagagcagaggcttctctcagctctgtacactctacaccctgagaggaagtcggcttctgagatgcaagactcttttataaggaaaagtccagttgtaaagattaagaaactttgagctttgctagaggtaaaaataggatgtaagtcaactctggagcatttaatttccaaatgtttatgaaaaagacaatcttcttcctgttttattgtatggatagagaatgagagagattctgtactctgggctttgcaaactcactagagttcaagaataaatacactcagagaggtctttcactgcaaagaagagctttgaaatcgaatgaactttcaggatatcagttcggctcctgtatctctaacaacgcagttgacatgcttgcccttcctagggatctcaggggccaactcctaactcacttgtggataattgaagtgcattcaaaggagtaggagcacagagacatcagggagaggaataggagagtttgcagagaatctggcttgctgtaagacaatgagttcatcttgaaataattggagtgtgaggtgcagatgaatatagttggcaagatcctaggtaagatatactatagagaaggctttatgaattggtaatatcaagacaaatccacagagagcctccgtaggtgtgcatttgtgtctcagatcaattatagttcagtcctgcctgattcatctcccagagatgcagcctccacttaaataaggagctttcaaattggaggtggtggcccattcagtgacgtcactgacagatgcatcttgtgtggataaaatgtcacaaaattaatttctttgttcatgctcacagaggccctggtctggaatgttccacttctgctctcactctgccatgggctcttggaccctctgtgtgtccctttatatcctggtagcgagtgagttctccgatatttattatggtcatgctggacctctgtctagatgactccttatattttccttattctttcccccaattctgtcttcttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagctttgccacagcactgcagaatctccccatctctgtgcagaaaccctggtgcttcctcttctccccacagctctcagcagtcgtcagcaaagtctttcctgctctctgctcaccatggctcacgcctataatcccagcactttgggaggccgaggtgggtggatcatgaagtcaggagatcgagaccatcctggctaacacagtgaaaccccgtctccactaaaaatacaaaaaattagccgggcacggtggcaagcgcctgtagtcccagctactcgagaggctgaggcaggagaatggcgtgaacccgggaggcggagcttgcagtaagccgagatcgtgccactgcacttcagcctgggcaacagagcaagactccatctcaaaaataaaataaaataaaaattaagtgggtttggagaatgacaaagacagaagatggtaggatattaacataaaaaaaatcatgtgtaggggataatgtagaaaatgtgttttgtgaatttctcacaaattgtctaaggagtcagaattcacaggcatgtaagataaaccttaattacccccactgtaggtttccttgtctccaggtatttgccatccgcattagcaagctgagagctcctgagaatggctatgtcttttgaactagtctgccctctgcattctattttcaccctaagctgtgaacagaaatttcccccacaagttttcttgattgtaaaagaaagttcttttctatggcattccttataatgttaatttcaacttaccatttatatagggattttgcattgcacttaaagagtaaacctcctgtgggtaatacaggcagtgaaataggttagatgtaagctgctcctcctggactctagggatctatttgtctttatcctgcttaaggagagccaagttctagctgaaggcctgtgccaactcacaggacactgacgtggtctcttccactgcctgcttggagctatccacatgtatccacacaggctgtctaaaagcacacaggcctggccagtcttactttgacctctttcctccctgatgctgtgtcctggacacgcatatctatatattttttctggtttatgccgcgtatttctacacagcacttgcaattcattctgaagaattataatttctttcttctatagtagtacttacatactgatcacttctcaacccctatcagggtatcattggcaggtgttgcaaactattcctgtattttgagtgcccaagacaatttgagtttacctgagttcttccatataggcctaggtttcacttgtcattgtctagttttgttatttaaaggccaaggttttcaagatcacaacagtacagaataaaattcaggaattttttaaaatgtacatcaaccgacctactctgtgtttatctattgtcctggtgtctcccttgctctttgggcttctctttgctgcctccagatcactttctttcctccttttttgaagcccagctccttacatacatgacgttagaacaggacccttcattgctgcacttgcttttttcccttcagaactctcttcccattcagtcctgtctgctactaatcctgtcatcattcttaacgactactcatcccacagaccatttttacattggtttggctcctcacttttgaggattttttttaacctactttttttttaagaattgcttccatgattacagtaaatatctactgaataaatgcatgtcttcctcagcttggagatttctgagggttgcaactttgtcgaatattttatccattaatcctaactgtgtatattagacaaggaaggtattaaaaatcatgttttaaatcagaaaatcaataaatagatttaaagagacaaatgcaaaacaaaactgtttagagctgctgttctgggctgaactacagatggactgtgtaagaaatagtaaaatcatctggtaatttcaacttatctttagaatctttggccggaacagctccagggaatcaagggatcataggtggaaagaaagacaaagaggttaaggaagtgagaactggctagggtagcattctctaccttaaggttttcaaacataatatcaaggtcctcagtttatttgtaatttttttgaggatgaaaggaaattatgcacgtgacccaaggtatacacaataaggaaactgacacatgactttgctgagatggaattatattaaagttctgtgacactcacaaactcatctcatgctgattagaaactgtgattggcaatgctgtgtgttacaaaaaaattaaaaaatgattcctttaaaaacattatttctttaaatcagcattttccaaaaatgggggaaatattaaatactatccaattttggtggtgcaaaaaataaaaaagcttaggggcttccagtacccctgacccagctgaccttcctttcccaggcccatgtcttttaatgtgcatttactcagggaaagggaagtgtggctgtgcaggaaaagtggcaatttagaaaacacaggctcaagggcttgatggagggtcccagaagagggcagggcactggtgatcagaggggattagagggcaagctgctagggtaagctgtgcatcagaagtggttccttttgtttccttcagcagtaaatttttattatcattattactttagctgtcctccatatctacttctttagtatggctggctacttctctttccaactctttatgcactaccgtggatctcaccctaggcagaaacaaatccccaaactctcaccagctgcgctcatgaaacaacccttcctggcaggctgtgatctcgccaagagcgatcaagttgatcaagctataaactgacttcatcactagtctaaagaggaaactgtggcaagaacagctgcaggagaaaccctaattacaatgggaggagagacataaggattttaaagcagttttcaaactagtccttctcaagaaccaaacatataagggatcactgggagctgtctctgaagtgggttaaagagaaaagaacagacaaagataaggttctgatgcctgctctctgttcctacagatctctccagaagtcactgtagacctgctacaatttccctcactttgctgtgacacagcctttcttcgttggttcctcctccctatgacttaaacctctctccctcccctcccctatctccattcttccagaaaattcctctgccattcccagagacttgcagaacactggggtttgaaatacattaaatagattttttttaattaataatgatctctgttaagtaacaaaagtttcatatgtgaattgtgcacaaaaaaattatagtaaacttctgagataatgttagaaggcttatgtaatgatcaggctagctttgatgaaggaatttgggactcagggtgagaagacaagataagttagtagacaataaaatgagttgatttattctgtagtagttgggaacttgtttaaaaaaatggagaaagaaattgttgaaaaccctaactccctcaagaggtctgggaatcctgtagcttacatggaatagaaactgaaagggaatcgcttgaacccaggaggcggaggttgcggtgagcagagaacatgccattccactccagcttgggtgacaagagcgaaactacatctcaaaaaaaaagcatgatcaaatttgaatcatagccaaatcttacaaaaattttatgtgaaatatttaattttgccaaaaaaaaaattgatgcaatgacctctacccttgttcacctttttttatcttcactatgtcacagagagtttggcacataatagatgataagtaaatttattttgactctattgagtaaatgacaataatatttcacattctctcaatataatagttgaattctatgtgtactttcttacttagcagagtttcacttcaaaaggggcttcgtcctccacatgaaatacaacagagagtcattatggctagtctcaattttccatacaacttctgcaatattccaagcaaatgtgtttccccagtcaggattaatgaccaatgttacacagtatcctaaccacatctaaagctggaatttgcaaacatccttttggaacaaagaaatttatgttataatagtatttatccagtctcatgatctggtaaaataaattcttcaccacaaccacattttcccaaaaccacattttttgaggctggaaacatcatcatctcagaaagcaccctaaaacactgtaagaaaaattcaccgtgctcggtaatagaatcttatcatccttgcaataagaagataccgtgtgtatgagtgcgagtgtgagagtgtgcatgtgtttatatgtgtgagtgtgtacacgtgtgtgtgtgcattttctcatggagactcatccacatgaaaatagtttctctttggatttcattactaagaggcactgggtgattggtggagctcataggcagttctggggagtgacaggaaatgtcagaccactcaatctgcctaagttatagctgatagggttgtttatttcaagactttctataaattaagaattaaatatgaaaaagcccagagacctccattataaaatgcactatctaaaattctgtaaataatccaagtacaaaatatgaagagatatgtgtctgatcaatcaaaaggagacatggaatatcgcgtttccaggctggatctgtttgatctcttcaagctgttttactttatgccctgtgttattcagggttctctctttcatcttatcatatgaattgcaattatgtaacatttatcagcaatcaaaatattggttaatgcacccttttgtctccactggctaagggtggatttgaagatcaaccctaaattggcctgcttgggaaagcattgaggttgtgtgtgtgagagggtagggtttgtaggagcggagatgcgggaatccctgttcctgatttggacaatcttgagcacatcagttcagaaagtgtgaatccatgagactctggacagttggccacgtggaggcactgtggcttcacaatgcagtggggaaccttggagagcggtgggagggtgacccaggagaggagggctgaagggaagcctggttgtctgctggcatcagcagggcaatctgagttcagagtggatcctgagttaaatactgccagagaagggtaggggtgccaaaggcctcaatttgccccaaggaaaaagtgtctctgtgtctgtatggacagtggagggtgctgaggctggggtgtcaagggctggggaatgcttctcaggacagggacagggtgggcaggcataggaaaataggggttgttgtgagcatgtgggcactgtgctgcacctgccccacctttcgtttaggggccctgcagaccaggaatggaacatggaatagcagagcctgaggcctgcctaagtatgcagtgagctcacagtgtcctgcagggccagtaactggaaaggccagtttcctatggaaatgccagaaatattcctgccctgactgaggttcaggatctggtggcagcctttcccaggcactctctgctgcttctttttttttttttttgagggcatcttgctttgctctgtcaccaaggctggagtacagtggcttgatctcagctcactgcagcctctgcctcctgggttcaaatgattctcctgtctcggcctcctaagtagctgggattacaggcacccaccacaacgcctggctaattttttgtatttttaataaagatggggtttcgccatgttggccaggctggtctcaaactcttgacttcaaacaatctgcctgcctcggcctcccaaagtgctgggattacaagtgtgagccactgtgcccggcccctctgctgcttctttatgtgacctgttttaattctgacagaaatcattcaaaataagtattatcttacctgtttatacatttgactgaagcagctttcctgggtctcacatacgcttagatggaagaaaccagacctggcattggatagatcagtagtagtgtgacagtagttaacatcagccaattatgcatttcaaaatagtgagaagagaataattcaaatgttcctagtctaaagaaaagataaatatttaagataatgcctatcccaatgaccatgatttgattatacaaatgtatcaatgatcatatctacctaaaaaatatgtacatctaatatacatcaataaatagtgaattaaaaaaaagataactggccgaagcctgttcctccaacacctctatccactgttcccactctgtagatttgtcctctcacctggccttccgtttccaggtccccattagcaggaggggaagattatgccacatatgtgatcattatagcctctccactgacaagtccaaggaggatatgacttccaggcaaaacatcttttcatctttcattgtgacaaaaatcaaggttcagttttctccactatagcagttctatgggtgaggccatgtgattgcttttatggaggctgtgtgaggagggaggtttctcagctgcacagcaaggaaataagatgttgtttaaggaaagcacagtcttccagtacctgatgcaatttaccatgagggaaaagacacaaataattgctattcattagttaattttattattttttaataagacacaaagtcatctaaaatgcaaagatagtagtctgataattaggtaaaactaacataaatggttgtgtcttaagggaaagtaaaaatgttgccccttacagcacttcctggttgatactgagtctgatatgcaagaaggtgtgatgctcccagaaagctgtgaattcagagcaatcagcaatcccacaaaagagctgatagaagaatgggcggttttattagaaagaagaggagcctctagtgccttccacgacatcctcactgcccacctctgatttcaggcttgctgtagtggacagttgtgtgcaagtccccattcgcctcgatctggcagtgcccttccacaggtgcatgctgggagtctctctgcttcttccccagggctgttccatgatattatctgagcccacctggcctgtactcaaagacagccagagctcctgatgcccctgctgagacagaggactaatgctccagcctgcccattcatgcagaaacttcagacagcattctgtgtgctcctgagaggccctgatggattccatctcctattgctccaacacaaactcttttgttgtttgtgcacttttatcctggcttcttccttccctattttatgtttcgttcctacttcttcttcctggaatcatttcccgaataagctacatgcacctaagtccccatcacagactttctcttcagggatagcctatactgtggcagtgatgggatgaagccaccatccaaagacccttccctttgaaggagacctttgtttttcttttactcataccgctacccattcgtttaaaaagtcttatgatgacatatataaactaatctcttccagattcatttggaattattcctgaattctcagcagcctcaggatggctctctgttcccttaaagctctgaacccaatttgaactgaatagacttgggttctctttacagaagcagagtttgcctggacccaggtaatcattcattccatttttcttccattcaacaaatctttaatgagctataggtgcagagtagattcaaattttgtggggcacaaagctgatacaattttaaggagctccttgcaaagaagaatgcaaaatgacaaagtgttggaaaggtcctgtgtgagtgagaaggcccgaggttattcttcattgatttcatggcaactacataggtactgtccaggtacttgggaaacaccagtggagaaaccagacagagcttcaagttgaggtagacacttccaaaaaattgttataacttattatactgaataataattaaaaagtaaaaggatatattccccatagatgcttatgtctccagagaagttagagtgctgttgaaagtactgacattctgggtagctcacacctcatttagggaaggatccttagagctctgggattctacgtgccgtatcccaaaaatgaaagtcctgcactgaaaagatttttttttcccctgccctggcccaaccacgaagattggcccctttgcttggtctcccaggaccagatgagttctgggcatagatgggaaagtccttccttggcttaccaggccccagccacggcctcccatggggatgctcatgggcctcctccctgtctccacttctgattctgtgtcctctctcactggagcatgattgtgggaattacccatccaggttgcatcaagatatgcaatagataatctattgtatctgaaataacaatagcagtgctattgactggatgtaagtttggtgccaaagcacgtttacacctcctccaatcttctcccatttagtgaatacaagatcttctgaatggaaatagaacatttccctgtgaccctagagactccagatagttgtagttctgggtgaacatttcatccacattcttaatgagcctcctcttttcttcataggaagtacagtcacttatgggacttaggtggtgagtgtttgtggcttcacctgaagcaaagggaaaaatcatcctcatgagaacacaccgcagcctgagcttggatggtgaggctcccatcaggtgcaatgaggtgctacagtgtgaaacaagacttcaaatgttaaagaccttgaatccacaactttgaaacctttctggatgtcagttgactcttttaaccaagggtatctctgtaggctgaaatacaaatatccagaggttaaacaaagtggaaaataattcaacttggagttgaattttgtacagagaagtcataaaagtcaccaggactgctatgacaatgctctttagactacagaaatattcataaatgttaaaacagcattcaaatgaagaatttagcataatgggagtaaaatacgcatagaagaacaaattcccctattaaaatcagggaatgagattacacattttaagatttctttcaaaacagatctacaaatttttcccaatctaagcttctcaagtatgtctataataaatgatttgttcctgtggggaagagaacagatgtggcaggttagctctgaggttcaagcatttagcagggacagtgacatcatcaagtcactgagagctcaacttcaatttgcccacagcagggctgggagacacaagatcctgccctggagctgaaatgggcaccaggctcttcttctatgtggccctttgtctgctgtgggcaggtgagggctggtcacaggagggcctccttccctggaattcccaaggactcaatgcaagcttttctgttgggatgacagcatcagtgtctgttgttctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgagtccacagtgctgcacagctgcctcctctctgcacggaaacggcagttagaaaaactgaggttgcctgtgcacccaagtctgggccccaccctgggacgtctcagcccccataggagtcacagagtcctgcccaggttgggggggtgtcttagagcaggggccatatgaccctcagtgctgtggctctattcctacccctgtctcagaccatctggagtttgccccaacacactaaccttgctgggtctttcttctgcagctctctttttctgcttgcagaatggaagagatattttgttgatattcctaattcccttcataatttcaaagccaacatattcttctctcccttatgggatcagtgacttcttcgtgtaaaccttaccgtatcctctactacccttcaactcacagacacaaatcttcccccatgtggtctctgctcctggctgcctttcttctaagggcaatagccctacaaggtcatctatcatttgcccttcacctgcttctccatcatcattttgtttttttttttttttttttttgagacggagtcttgctctgttgcccaggctggagtgcagtggcgcgatctcggctcactgcaagcccgcctcccgggttcgcgccattctcctgcctcagcctcccaagtagctgggactacaggtgcctgccacggcgcccggctaattttttgtatttttagtagagatggggtttcacggtgttagccaggatggtctcgatctcctgacctcgttattcacccgccttggcctcccaaagtgctgggattacaggcgtgagccactgcgcccagcctccatcatcattttgcattaagtttcccctggctttctgctttagccacactcccctacattcagtttacacgttcgcaggtgtagtgttgttttccaccctggggattgtttatgaataatagattatttctacttcactgagcatatgtgcctccaacttattcccaggcctccacttcattccttacataaaagtctatttcaggtacatttactcttaactgtaaaaagcaagacaaattttatgagagaaaaattaagaaatatatttttagcactcatttgaggaattagttttttagatgacacataagaaaaccactagccataaaaatatttgaggccgggcgcggtggctcatgcctgtaatcccagcactttgggaggctgaggcaggcggatcacttgaggttgggagttcaagatcagcctgaccaacatggagaaaccccgtctttactaaaaatagaaaattagctgggcatggggtgcatgcctgtaatcccacctactcaggaggctgaggcaggagaatcgcttgaacctgggaggcggaggttgctgtgagccgagatcatgccgctgcactccagcctgggcaacaagagcagaactccacctcaaaaaaaaaaaaaatttgtaactccagttgcattaaactaaacttttgtacaccaaaacatagcataagaaatgaaatgttaagccacagcacaggaaaaaaatgaggaatgcatgcagatgatgaaaaatcagtgtgacagagaagagtcaggctcacccatggctcctctatgcttcctggcctcatttgcacttggagggctgggagcatgtcaccaggttctgaatagtgggaggtgagtaaaaataatgttagcccaatttcaagtctggcccttaaaaatatcctgtaggtccatgctgagggtccctaagcgtactcccgtgtttagagatgtggtatatggcatagagttgtactcacagctaagattttctaacatgtcttagtaagttgtcagcagcagatcatatggagaaaacacaggtggaatctgaaggaatccaaactcaggcctccttatgctgtcttcctcccggggaggtcacacagggttctcgcttcactccgtagcaaaaatgcattaacacatgtgcagtgtttctaccaagtgagtccaacagagactcagcactcatgaggtttcagaggaggctggtcacaagcacatactgcctagcattaaccaaaaattcagactccagaaggaaatctggtgttcagtacaatactgtttgcaacaccagtttaggcacaacgagccgctcctctcagttaggagaaactttgccagtgcagggcatcactcatcagccaagtggccaaagatcagccaaagttcaatcttgcaagcaggcagtctcaagcctgctgtcaactcttttctgcacagacactcttcaactctcttttgccatgtgtggatgaatttgggaggtcatggcacagattataaactggaagcagcttggctccctgggtcataatttggtggacagccatggaaaaaaagctgctcatgccccactgggttttgtggtcatgagaggtaagacttgatagagttcagccactgagattttaggatttgttttatttatttttttttctgtagcataggtgtccttttctaataaacttagtacataaatgagtaaaacattcttattaataagacgacagcccaataaaaatggcaatactgaagctaaataggcaattcacacaagtgaacataagttaccactaaacatgagaataacttttcaaccttacttataatcagaatatagcaacctgaaataataagttatgattcaaaaattactagataggaaacttttcaaaggagtgacagtcctaaatctgaatagacatttgaactaatgaaaaccgtttatatatccactagaagagataatgacaaccacatcagaaaacccactgtgggatatattgtgactaatagcatttcttgagaaattatgagtgtatataaatcatttgggttccttttcttgtctttaggttcaatcgtagaaaattcaactttaagtatttatttttcctattgtaaaggtagttttttaaaacaatcttttaaaaaagtgggctgggcatggtggctcacacttgtaatcccagctactcaggaggctaaggcaggagaatcgcttgaacccagaggcacaggctgcaatgaaccaagattatgtcactgcactccagcctgggcgacagagtgagactccatttcaaaaaaaaagggtgggtggcagggggaaatatgtgtaacatataattttgtcactttatttttaaattgtacaattcagcagcattaagtacattcactatgttgggaaactgtcaccattatctgtttccaattttcttttcattgcctcaaacagaaactcaatacccactaaagaataactccacataccccctctttctgctaacctctaatctaatttctttctgaatgaatttgcctattgcagattatttatgtgaaaccatgcactatttttccttttgtgtcttgtatctttcacttagcttaatgctttcaaggtgcattcatattgtagcatttatcaaaacttcattccttttcatttctcaataatattttgttgtatgcatataccacatttgtttatccattcattaattgattaacatttgggttgtttctaccttgtagatattgggaataatggtgcaatgaatattggcctgaaaatatctgtttgatgccctgttttcaattcttttgggtatatacccaggagtgaaacttctgggtcctttggtaattctatgtttctccttttaagtaactaccaaaatggtttttttttggttgcagctgcacaattttagattcctaccagcaatgtcatttcttcacagaattgccagcatttatttcttgtttttcttttcaaaaatattatgatgatgatgattactattttgtatagccatcctagtcagtgtgaatgatatctcattgtggttgtgatttgcatttctctaatgactaaaaatgttaagtgccttttcttatgcctatgatcaatttgcacaccttctttggaggtaatgttttttgtctgattggcttttttggggtgtctcttgactttagaattatgttggtgtactgcgacaatgctaaaagaaattgagtttgaacttcatttgggaggtttgtggttggtagtgtttttagtgcggtacttcttaaacatttttaatataccatagaagagagaaaatgattacattttgatatgatttggctgtgtcccaacccaaatctcatcttgaattgtatctctcacaattcccacgtgttgtgggaggaaccctgtggggaggtgattgaattatgggggccgggtctttcctgctgtctcgtgatactaaatgagtctcttttagatctgatggttttaaaatgggattttccctgcacaagctctctcttttatgttaccatccaagtaagacatgacttgcccctccttgccttctgccatgattgtgaggcctccccagccatgtggaactgtaagtccattaagcctctttttcttctcagtctctggtatgtctttatcagcagcatgaaaatgaactaatacatatcgtgatttagggaactcctttttggattgaatttaactggcaacctctgagctttctgtacctggatattgctaactttttccagatttaaggaattttcaaccatgttttatatatgcttttgggactggaacaggatatggacatttttccaatgcatcactccacagattactactcagttacagagggtaaaagacatattaaaaatgaagagatccagtgtcagttacctcaaatatacattgacaaaactgcataaaaatgacattccacattcttgcaattgaccagatacaataggaaatacacatcatctgtggtgtatatttgccaagtaactaacctctaatagtatagaaattcttgttgtggctcattttacaactaagctgacctaggcacttcaaaaacttataatcatgaaaaacaggaaatataataagtgggtggaagagatgtataatttaaaagtaactaaggagaactgctaacctcatgaaatacgtgatctttgattttgttctagaggaaaagtgaatcaaaaccaagggacatgctgagacaactggagaaatttgaatgtgaagtatgtactagatgacaatgctatgtgaatgctaatgttttgagcgtaatagtgacatttgtggttatataagataatgccaattttttaggagactcattttattattaaggataaaatgcttcagaaattgagggcaaaatatatatagagagatcaagcaaaatcacaaaatgtacaatcggcacacagatatacattttaatattctgattgtttcattattctctcaccttttccatagatgttcagtttaaaaaaattgaagaaaaatattaacagaccaaaataaaatgttggtgttatttcagagtaataatgttgttgggtatttcttatattcatttttaatatatttgaaatactatgtcattaccataaaataaatatatcaaataaggtatcttttagtctagagtatacttttttaaataggagacaggctatgatttttaagaaagtcccaaaagaaaacaagagaatttgcagtctgaggacaaagcagcttggtatctctgagaccagtgcaaaacttagctagtaatgcatgtcaagaggccttttagcaaatatacaggactgttttctctgtatcaagagattctgagtattctacagtttggctgaaaactcaagaactttcaaaggtgactgaatgtaaagagaagagtagtgattttccaaagttagggctggacaatatgtatttgttcaacaaagagggaggctgtctcagtttatcctctgctgctatagcagaatacctgaggctgggaaaatgtataaagaaatttataaggaaaagggctttatttggcttgcaattctggaggctggaaagaccagtagggcatcaacatctactgaacttcttttgagggctttgtgctgtgtcacaacgtggaagagaagtgggagaaatgagcaggcctgtgcaaggagagccaggatgagcaagaccctcactttataacagcctgcttttatggtaactaatccagatgctggagagagagaactgactcctggcattaatctttgatgagggatctactcccatgacccaaacaattcccataaggctcacactaccccagaaaaatgtgagcaatgtgcctgtagcaacaccactacattgacgaataagcttcaacatgaattttggtgggaacacaccataactaaactataggacaggctctagcaagacagtaagaacaggtggaactaggaaaaaattttccctggtttctcacaaacactgtcctatattagccctgattctattgaagatagtatagaagtcccaccagtatctctaagccatggaccgaggacctaagtccagtgacactggccatcagaaggcactggggtttgatgatgctcaaatgtttttgaaacagggctcagtgctgcctgagatgttaagtttaaaggaaaagtgtgtatcctagtatccagtatcttgtttgcagaagttgtgagtagtcagtgaaatgtgaaatattaaaaaaaaaaaccctttatctttcattggtgctggcatgttctgctcagcagtaaaatctgaactgtagcaaatcttttgagtggagactcttctgggcttgcatgggaggtagatggaggaggaccaggagccagcctaaatgctcagagacccatgcaaagggaaaatgactggctcctcaggagaattcagagaaatgtgagcaatgcacctgtacctcacaccttacctattctagtcgtgctctggacaatgtatacgatgatgtaagggaaatataggagagtggacaattctagtttatgccagataggctattccaaattgcaggtagtaactacagatattcttaacaaaaaccggatttcccagggctctggccttttcttccctgagcagcacaatgaccagttcctgccttgacaagaattctgtcatagatttctcagttgcgctgcccaggaagcagatgaggcctgggaacaatgaggaatgtcttccctggacttgacatgcctcacttgcaagcacaccacatgcaggtcctgtggactgataggcttgatagacagataagtcctgtttccagctaccagcctccatcccctgaatgctgttgtcacccagaactgtaaacctggtcacaaagatggagcaggtagtggccccttaatgtgaagaaattttccatcatgcaattattacctggtgcctacatgagttggactcaaaccagcagatttttacctcagtagtaaaggatttatgacagaaacggatggctctggtaattctatacccacaggtattcacctgataaccttgacatgtgtcccctaggttttgcaggtttggtggaatatctctgagtgcacctcactgaacacatatatcctcattcccacctccctggacgtgcatctccttgtgttattgtcttatgccaactctgaggagcgccatcccctaactccttttatttcttattactcaggcaaggaataaaagtgcgtttgtgactaatgttgccccattagaaacaaaaaatagataatgaccactactgttcaactgtaatttacactagaggtatagctataaggttatttttagatttcagcaagtctctttgattttgcatttcttacaatatatactgatattttcagggataagagaattccccacctatcttcgataaaaatgagaacttactttcattgcactggtgacccaaaactacaggcagagccatgatgaaggcttggtacacaatgtatcatgaatgataacagtaaagaggaaactgttcattggccttcactaaaaatgaacccttccaactctgtgcccaggttattgttttatccctttagcttacagcgcgtcagctaattcaacaagcttctaggataaacttgtgtcaattaccccagcttctaagtgcataggaccaggaagatagagaacctagtaaaagagaaacacccaaagagaaggataattgctgataagacaaagaggtcactaactgatatctctgtttcgagttgccttcaactcgaaacatccagcagaggatgggcctagagatggagtaggagatccagtccccaagccctagagatgtgagtgaggacacttggctgaacttacacagtctgtgaatacagtaaagcaacttcgtgctctcttttagcttataataattggtttctaacaatgtaggcatttgtggaggcaatgatgtcactgtgggaactgccatgagaggacagggacgtccctcctcctctgcttttgctcacagtgaccctgattgggcaaagctcccatccttccctgaccctgccatgggcaccaggctcctctgctgggcggccctctgtctcctgggagcaggtgagtcctaggaacaccatgatcacattggatctctctgattatttcaatcatttccttctattttcaaattctgtctttttccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcttagacacagtgtagcagagacacttccctcctgtgcagaaaaccagaaaaccgcaggactctctcctctctactcagctcacagcagcctttccttattcctcatcctcccaaggaagaagtgagttttcagatatagctaggactcatatagtgggaggaaataaactttttcttttcttttctttttttctttttgtttttgagatggagtcttgctccattgcccaggctggagtgcagtggtgcgatctgggctcactgcagtctctgcctcctgagttcaagtgattgtcctgcctcagcctccccagtagctgggatgacaggcatgtgccaccatgcccagctaatttctgtatttttagtagagacgggattttgatatgttggccaggctgatttcgaactcctgacctcaagtgattcgcccttctcggcatctcaaagcgctggaattacaagcttgagccactgtgcctggctggagataaactatttcttaaaacatgaaggctgcagttgttatttgaaaatatgtctaaggaatctgaaacacctatcggtgagaattcaagaaaccaaaactgaaagtgacttatcacagacttagtcttctggggtactaatagttgttcttgtatttaaaaaatgcatacaatattttatatcaattaaaaaatacgtaaatttgaaaaataaaaacatgcagtcaataaacatgtgtgataaactttaataatacagataatgattgtatgtgagtaacaatcagcaggttttctctctgcagttgtcagcatatgaataatttgaatcctatccttggtgacaccctggctctggagcctcctctagacctctcattggatgtattatgcaaccaaatctcaacaggtactatgtgtttggaaatctttttcccctgtttttgcagaaatatgctaataagagtaatgttaaagatgatgatgttgataatttcaactatttcattcggcaccctttaaatttcaaaaaaatgcacacaaatggatatcctggcaacgagtccaaaatcttagctcaaaatgaattctgctactccagagctttctaactcttccatgtaacaaacatatcccaacattatatggggctgggccagctagttcagagactgatgaggacactttcacttgtctgtcctcatatattaaaatagctccttagttgatatggtttgactgtgtccccacccaaatctcaacttgaattgtacctcccagaattcccacgtgttgtgggagggacccgggggatataattgaaccatgggggccagtctttcccatgctattctcatgatagtgaacaagtctcacgagatctcatgggcttatcaggggtttccacatttgcttcttcctcattttctcttgccgccaccatgtaagatgtgccttttgcttcctgccatgattctgaggcctccccagccatgtggaactgtaagtccaactaaacgtctttttcttccctgtcttgggtatgtctttatcagcagcatgaaaacagactaatacatcagtgcattagatattcctgaaagaacttcagaagcaattaactgcccctggtccagttgcctcctctgataatgcattgtgtgtgtccaactctagtctctaccctatcttctgcccagactgtcttgtactagaaattattctgaagtattggttagaatgtttggaaatgcagcttcctgggaatcttctgaaggactgtcactgtccctcagcccctcctgacttccctttccatccacctgactgcaggtcctaactgatggccatgaactcactacacatctcccttccttccctgcaatttactcagctaacaacacctcagccaggtggtgggtgaccatgaccatcctcctcttccttgccagaattttcatttggttctttttctgatctataaggtcatcttttacagtcagtcattccctcataaccttttttgagtgtatcttttatttcgttgagcataggacactcagttatttcagtctgtctgcttattttcacctctgtggtctttgtggacatttttgtatgtgtgctgcttctcagtcatttgtttgtatttttccttttaaacctgattatttttgacatcatgccagacactatggctgtagaaataatttctggtctaggatggatatatctttctccagagataattttattgtgctttgtaaagtgcatggatgcataaacaatccaggactccctggaacagaattaaaggcttgaggtgtcctggagaccctggaggacaggcttccttctagtgcattgattctattcaagtccctcaatggtcacattaagtaagttatggtctttgcctttacccctctggactgtgagtcagcttccttagtgctgggctgggatcagcaaatgcccataagggcagtgactgctgtgctcactcccgaggcccctgccttctccaagattctggcccagttattcctcatcgtatctttaggatatgaattagttgcagtttgttagtgtggttattttactcaagtacataaataataacaaaagcattaatctgagttccctcttctgtaattatacagattaaggtcaaaacattttatctgaagttttaattttctttgaattttaacgtcagattcttagtctgatttgtttgatatttgacttaaacagcgtagagatgttatacagaaactttaattttaaggaaagaactttttaaaaacttgaagtggatttataatcaaattgggacccttacttggttttgaggttttatcatttgagtatttttatgttatttattacataatctttgatgcttcactggatcataagacaagatgagaacagagagtgaatatttagacttgatcagagagcacaaagtgaacatggaattagtttctgttgatgaacagtccaactatgtaaaatatttaaagacatttattctgagccaaatatgagtgaccatggcctgtgaaacagccttctggaggtactgagatcagtgcccaaggtggtcagggtgcagcttggttttctacattttagggagacatgagacttgagacttcaatcaaacacaattaagagatacattgtttttggccagaaaggcagacacctggaggcaggagtggggagaggttccagcttaaaggtagatataaaatttttctggttgacaattggttgtctctcaggttaaattttaaaagagccctggctgggtaggaagtccattcagattattgggggccttttaattttatttgtggtttacacttcatttctgcattgttgtgatccatttgtgccatgttttttgagtacacctgagggccaggggtcagaactagagggagtcacagatgtgtgactatcatcttttcctacttaagcccaggcttctgggaaaacactttgctccacattttccatttgagggaacttgcctaaagcaatgctccagttttattctttctattgcttgccaaatcttccctatgggaagggaaataagttattttatttagtctcctcttcatctgaggttcctctctcttcattctctccctttcatcctggctactgggaataaaagcagattcttttggtgcttttttaaatgcactaagatcagtgggaaactttcttttccttatagggatggcctgtaatttggaggggagagagaatggattaaattctgattcaagacagtgttggtcggtctttttgccctcccatctgagccgggttgtttatggatattaaaactgatattatgtctccatctgtcagactgtaatgtccatctctcaggtggttccatcttaggtcataatgttgttttatgaccctccaacaccacaaattatggtatctcgtttccccatggctcaataaagggaagtgcaagtccttggtcttgacaaagagcacatttgtgctgttcctgcctactggccaccaggaggcactgtggcttcactgtcatccaaagtctatgggggaggggctgggattgctccctggaggatccttaatgaaaaccctggagttggacctagagtcagggagctgggttggaggtacctgcaatgaaggctgaaaataaagggattagagaccaacccttttgcctcttgatgcggagatgggttttgctgtaaattgagatttgaatagggctctgagtggcagatgggcttgcaagtggatgtaggtctgagctcactgaagacgtggaggcacaaggagctggggtggtgcggcgccgtgttctgggctggggaaagcagaaaagcagtgtttgtgtcacaggagccttgtagagcctggccccaagccggccgaggctagccctacctgttccgtcgaacgtagagggaagaacaggtagaaatggaggcgctaccctggaccatgtcagggggagcctgtcctcaggcagcttcaatcacaatgatgtaccagcagcatatacacttattagcaaggcttagggtggagtaggacagaattttctcccccaagaacctttgctcagggcgggaaaatgctgcagtctagttctaactctattactccagatgcctctgtgtccctggaagaaggtggggtctgggcatataaaagttttgtttgttttgcctgggttgatttcgtttttccatgtgatcgtgcatctgactctaccagtattttgtatccggcttctgcctctctctctcatgagtcccatggctactataaggtattcaatttctattgctgctgtaacgaattaccactaacttggtggcttacaaccacacaagtattaccttacagttctggaggtcagaagtccaaaatggatgttactgggctaaaatccaagcgttggcagggctgcattccttcctgaggctctagggaagaactgtttttctctccttttcagcttctagaggccaccagtgctccttggctcatggccccattcaatcttcaaagccagcaaggactggctgagactttgctcactctgcatactctgatgctcacttttcatcctccctcttccacattttaggaccattgtgattacattgggcccctatattaaggtcagctgattggcaagctcacttcacttggaacattaattcccctttatcaggtaatttaacacattccagggattaggcctgggcatggttgaaggggcattgttctgactaccaaacctaggcacctggtaatagggaggaaaacgtgttggtcaccttaaaaactgattgatgactaccgttttacattctggatctaacacacacaacaaagggatggaacccacaaggaaacagacacctcaggtcacacaagctcatctgtaaactatttgctccttaggatgggcaagtcccctggggcgcaggggactcagctgtatgcctctgtgccaacagcgaaaatgtggccttaaactgctccttcttctttgttagcaaataacctagttgaccaattcatagagcagaggttctctcagttctctatactctacaccccgagaggaagtcagttagtgagatgtaagattcttttataagaaaaagaccaggtgtaaagattaagaaatgctgagctttgctagaggtaagaataagatgtaaatcaactctggaacatttaatttccaaatctttgtgagaaagacaatcttgtttctgatttattgtgtggatagagaatgtgagagattctgtgctctgggctttgcaaactcaatagagttcaaggatcaataaactcggagagacccttcactgcaaagaagagctttgaaatctaatgagctttcgggacactgattcagctcctgtatctttaacaacgcggttgacatgcttgctcttcctgggtaactcagatgctaacttctaactcatttaaaggcatttgaagaactaggagcacagagtcaccagtgagaggaagaggagagtttgcagagaagctggcttgcaataaggcaatgagttcatctttaaatacttggagtttgaggtgcagatggatatagttggcaggctcctaggtaaggcatgttatggagaaggtgctatgaattgataatatcaaagcaaatctacagggatcctctgcaagtgtgcatctgtatctcagatcaattatagttgacttcagtcctgcctgattcatctcccaaaaatgtagtctgcctgattcatctcccaaaaatgtagcctccgcttaaaggagctttcaagttgggggtggtgggccattcagtgttgtcactaacagatgcatcttgtgggggtaaaatgtcccaaagtatcttttcttgcttatgttcataagggcgctggtctggaatgtgccacatctgttctcactctgccatggactcctggaccctctgtgtgtccctttgtatcctggtagcgagtgagtcctcatgtatttatcatcctcatgctgggcctctgtatagatgacttcctgtattttccttattctgtttcctaattttgcgttcttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgcttagccacagcgctgcagaatctccccctccctgtgcagaaactctggtgcttcctcttttcctcacagctcccagcagtcctgagcaaagtctttcctgcctcaccctccccacaagaataattaagtgggtttggggcatggcaaagacataagatgatacaatatcaacatacaaaatcttgtgtaggagataatgtcgaaaatgcattttgcaaatttctcacaaattgtgtatggggtcataactcacacacaggtaggataaaccttaattacccacaccgtaggtttccctgccttcctgtatttgacactcccatccaaacagtgggagctcttcagaatggctatgtcttgtgaactactctgcccacttcattcccttctcactctaagccatgaacagaaatttcccctacaagtactctttattgtaaatgaaagttcttttctatgattgtggacattcctttataatgctaatttcaatttaccatttatatacggatttttacattaaacttaaagagatcttcagtgtggataatacaggcagtttaatacattagaagtaagctacccctcttggcctacagggatccatttgtttctatcttgcataaagcaagccaggtgctagctaaaggtctgtgtgcactcacaggacactgatgagatctcctccactgcctgttctggaactatcaatatgaatatacacagggtgtctaaaagcacacagggcctggtgtggtggctcatgcctgtaatctcagcactttgggaggctgaggcgggaggaatgcttgaggtggggagttcaagactaggctgggaaacagtgagattttgtctctaaaatatatatatattttaaaaattagcctggtatggcagtcttagctactcaggaggctgagttgagagggttgcttgagccctgaagttcgaggctggagtgagccatgatcatcgcaacagagtaagaccccaaatcacacacaaaaaataaataaataaagttaaaaaacatacacaggcctggccagtcttacttggccctctttcctccctgatgctgtgtcctgaacagccaaatctgtattttttttcttctggtttatgatacacatttctacacagcacttgcaatttattatgaagagttataatgtctttcttctatagtagtatttacatactgatgatttctcaacccctatcagtgtatcatcggcaattgttgcaaaatgtgcctgtattttgcatgcccaagacaatttgggtttacccgagttcttcgatagaggccctggtttcgcttgtcactgtcctatttttgttattcaaagactgagactttcaagatcagaatgatgcagaatgaaattcggggtatcctttaatgtacatcgagagacctactctgtgtttatatattgttttggtgtcttccttgctctttgggcttctctctgttgcctccagatcattttccttcctcctttgaagcccagctcctttacacacatgacattagaacagcacccttctttgctgcacttgcttctttcccttcagaactctcttctcattcagtccttctgtctgctactaatcttgtcatcattcctaatggctactcatcacacagaccatttttcattggttttgcttctcactttcttgacttcctcacttttgacattttatccattaatcctaacattgtatatctgacaaggaagatattaaaaatcacatgttttgaatcagtgaatcaataaacaggtttaaagagacaaatgcaaaacaaaattgtccagagctgctgttctgggctggactacagatagatcatgtaagaaataataaaatcatctggtaatttcaatttatctttagaatctttggacagaacagctccaggggagtcaagggatcatagatggtaagagagacaaagaggttaggaggtgagaactggctagggtggcagtccctaacctaaggttttcaaggataatatcaaggtcctcaatttcttttaaatattttttgaaagtgaaaggaaattatgcacatgacccaagctatacataataaggaaattgactcatgtctttgctgagatggaattatattaaagttctgtgaaattaacttatgggctcatctcatgctgattaaaaaccctgattgacagcgctgtgtgttacaaaaatgacaaaataaatgattactttaaaaacattattttaaaaaattagcatttgccaagagtgggggtaaaaaatgacatactgccagatggtacaaggaatggagacgtttgaggcttccagagcctctgacctagctcaccccactttcccgggcccgatgtcttctaaagttcatctgtgcagggaaagggaagtgtagttgtgcaggaaatacggcaggttaggaaatcacaggctctagagcttttacaggcttttacatcctgtgtatctgtgctatttccacagtctgcaacaaactgtattctccccaaacagggccagacactcctcatctatcaaggactgactcacatctaccttcctctttgcttcttaccctgacattccctggccactgcagtatatcattctgtttcctttacattcagaggaaaattcaggtatataattgatactactcgatgtttgtgaaatgaataaattaatgtccatttatacagagctctgaaatattatctattactgttttcccttcaaaaggggctccttttacttgaaatatgatggagagtcattatggctagtctcaattttccatacaatttctgcagtattccaagcaaatgtgttttcccagtcaggattaatgaccagtactacccagtaccctaactatatctaaagctggaattcacaaatgtccttttggaacaaagaaatttatgttataataatatttatccagtcctatgatccagtaaaagaaattcctcaccacaaccacacttttccaaaatcacatctttatgagtctggacacattatcaggggtgcatttcagaagtcaacctaaaacactgagagaaaaatttgttgtgctcagtaatagaatcttatccttgcaataagaagataccatgtgtgtatgtgtgtgtgtgtgagtgtatatgtgtgtatgagtgtgtgtgtgagagtgtatgtgtgagtgtgtatgagtgtgtgtgtatgtgcattttctcatgcagattcatccacatgaaaaagtttatctttggatcgcattacaaagaggcactgggtcacctggggagctcataggcacttctggctagtgatgggaaatgtcacaccactcaatctgcctaagttatagccaatagggttgtttatttcaagactttttataaattcagaattaaatatgtaaaaactagaagccccttttattaaatgcactatttaaaatttggtaataatgactctaaatacaaaatatgaagacacatgagatattaaatatttttccaagatcattctgctggatagcttcacactgtttaattgtatgtcctgtcttattcaggctcctctcttccaccttatcatatgaattgcaatgacataacaacgattaattttgcaatcaaaatgttggttaatacactcttttgtctccactggctaagggaggatttagagattaaccctaaattggcttatctgggaaagcttagagagggtgtatgtgagagggtgggggctgcaggagcgggatgcaggggtctctgttacggatttggacaatctagagctcatcagatcagaaggtgtgaatctgtgagactatggatctatagccacttggaggcgctgtgtctccgcaatgctgctgggaaccctggggaggggagggcaggtgacccagaagaggaaggctgaagagaatgcctggctgcctgctagcatcaggtgggggccatttgagttcagagtgagttctgagtttaacacagactcctcactgtccagagaagggtaggggtgcgaaaggcctcagtttgtaccaacaagagagtgtctctgtgtctgtctggccagtggatggtgaaggggctggggcatccagggcttgggaatcagtgtcagggcagggacagcggtgggtggagtaaggtgtgacatggacatgtggacactgtgctccacctttagtttcgggacccttcagggcaggaatgatacatggggtagcagagccaggcacccacctaagggtacagtgggcaaaggatggcctgcagaggaagtaaatagaaaggcaagtttcctatggtaatgccaaaacattcctgcccccactcagaaaaagaccatgaatgggatgttggcagccagaggggctcaggatctggtgatccgacaggcctttcccaggtaccctctgttgcttctttatgagacctgttttgattctaacagaaatcatgcaaaataagtattatttaactgtgtatacacttgactgaaataactttcctgggtcttgtacactcttagatggaagaaaccagacctggcgttggatagatcagtaatagggtgactgtagttaacatcaaccaattatgcatttcaaaatagctagaagagaataattcaaatgttcttaaggtaaagaaaagacaaatattaaagtgatgcctatcccaatgaccatgatttgattatattaatgtatcaaagatcacatctactaaaaaatatgtacatctaatatgtatcaataaatagttaattgaaaagaagataactagctgacgtctgttcctccagcacctctacctgctgtccccactctgcagatttgtcctctcacatggccttccctttccaggtccccattagcaggaggagaaagtcaggcattatatgtgatcactatactctctttgctgaaaagtccaaggaacatataacttccaggctaaacatattcattcatccttcattgtgacaaaaaagagaggtgcaattttctgcaccatagctgtcctatgaatgaggccaggtgatctctttcatgaaggatatgtgaggagagagatttctcagtgcacagcaaagggaatgggatgtttttaaaggaaagtgtagttttcctgtacctgatgtaatttattatgagggaaaagacacaaatcattattattcattagttaatttattgatttcataaacattttaagccccctgctttgtacaagggattgtgccacataaatttaaaagcgaaacaaaaaataaaatttagaaaaacagataagacaatttttaaaaacagtatgtttctcgcctttgacaatattaaggcaattaatatggaaatgtatttattgaattattttgaaatttatattttgctaattcaaaatactttaatgtttctgaattatacaaatgtcctttttaaaaatctttctctttagttacctacctccttttaccacctttttaaaaaaaattttagtgagaacatttaatatgagatctatcctcttaacaggcttttaagtatatagtagagtatcgtagtccacagacacaaggctgtacagtagatctctagaacttcctcatcctgcttaactgggaattttatacctgttgacagcaactccccattgccaccaatccctagcccttggaaaccaatgtttcagtttttacttccatgagtttgactatttaggttgcctcataaaagtagaaaaaggcacggtggctcacgcctgtaatcccagtactttgggaggccgaggtgggcacatcacgtgaggtcaggagttggagaccagcctggccaacatggtgaaaccctgcatctactaaaaatacaaaaattagctgggcacggtggcaggcgcctgtaatcccagctactcaggaggctgaggcaggaaaatcatttgaaaacgggaggtggaggttgcagcgagccgatattgtgccattgcactccagcctggtcaacaaggcgaaactccatctcaaaaaaaaaaaaaaaaaaaaaaaaagagtcgtgcagtatttgtctttctgtgtctggcttactcagttaccataatgtcctccaggtttatccacattgccacatatggtgagattttcttcttttttgatattatttccttgtgtgtatataacacatttaaggtctgtggtaataaatgcatagtatttgactgtttctataaaaccacacatcacacgagtaacagggtcatttgcagaggtgcaggctctgagtacattaatgcacctttatggttcaattatgctgcacggagaagattcagaaaaaaaaatcataattccatcctttattgtcattttactatacacaaaatagaagcccttcatttgcaaaattgcagttaattagaaattcaactgtcagaaaaagccttaagacacaaatgctattctcattttacagagaggagggaattgacccacaggttaaataacatgatcacattaaatggctattaggatgcagtaccgggggtccagctctgacctgtcagtctctaagccctgtgtttatagctctgtgctataaggcattttcatgaagagagacgcctacctttcaaaatcagagtatttgctctctacatccctttcagacctgctggctccaataacatcacagacagagatgaatgtatcctggagacagtatggggaaagaactctgaaaagatgccatggcacccagccctgactcccactctaacaccaccacatcactaactgagaccagctcttgacaggttaactttagtttggtttttgttttgttaatctataaaatgagactaatacagtctatctatagggctgtatatagaatttagtatcataaaatatctagcctataataggaatctaaatctcttgattccctttgttaatctcagacagcctcttccaccctcaccatgcacaaaggcagattcagacacactctgcctagaaatcttaagctgagaacttagaagtcacagaagtggaaatatatatacctgatgatccctcacatgaaattaactaaagaatgtagcatacatacctcctcagatagttaaaaatcaacttcattaatatatagattatataaacattacacattttaagtgaactgatgagtgattttggagcaatatatgtgtatagacccttcaatccccatccctattaagatgccgaacatttccatcacacagagagtgttctcattcctctctgcaatgcctccctccatccctgacaaccagtgatatttatcactagaaaattgttttgctcaggtacatttttaatggaaatttacaacctctaactattaaaacacttcctctttagtacacaggtaaatattcaagagagggaggtgctcccaaagatatttatggctattcccctcaatgacagaatggataaagaaaatgtgacacatatacaccatggaatactatgcagtcatatgaaagaatgagatcatgtcctttgcagggacatggatgaagctggaagccattatcctcagcaaactaatacaggaacagaaaaccaaacaccgcatgttttcacctagtgggagttgaacgaagagaacacatggacacagggaggggaacaacacacactggagcctgtcggagggcggagggtgagaggagggagagcattacgatgaatacctaatgcatgcggagcttaaagcctagatgacgggttgatgggtgcagcaaaccaccgtggcacatgtttacctatgtaacaaacctgcacattcttcacatgtatcccgaaacttaaagtaaaatttaaaaaatttaaaaaaagagagattttttatggctttagaagggtttcaaacccttccagaaccctgagagacacctgatccacgttagggataatcctgtctggagatagacaagatgatgaaatgacaccaaaaatcttcccacatggaagaggctatttccacataatttgttcattcattttcattattttttctcatacactcattcacttaaattattttataatgatattctgacaaaaactaatcatctccaagaacattattttgagtttccatcagacaatatttagctgtgattcagctctgcttcctgagcacatagagtgcactggggccaagtgaaccatgtgcaatagtgactaccttgagagataatgtcacattgagagaaggggtctctcttccttgaccgcaagtgtccaacccataaaacatgagccttgagctagaaaattcccctttctgttctggcgctgcctgggcaccaggctcttttgctgtgtgtccctctgttttctggaccagagaaatactgggcacatatgtggcatctactcattggtttgttggaccctagcttgcagataatagtaccaggtgttcctttgctgtgactttaacttctgtgttcttcacaggacacagtcccattgatgggatccaaagtaccattgatactgagtgacccagaccctggtcatgtacttgtgctaaaaaggaaaacagcacatggggaggtgagcagaatatgaaacacaattatggactcagaaacagccatacaacttattagcatcccgttgtttcaaaaaatcataagaatttgaagaacatgacaatgttatactgactgtggcgtcctaataagtgtgggactctgtgcaccaagatatgttatttgaattcctttttattgattactaaattaatggcaggaatcccacacaaagggatactccctatgaaacatgacaactcaaattaaaaaagagcactcttccttactctaaagtctgccctctctccccgagtccctcacgcataaggccacatttgtgcccctaggtcatgggcagcgctggttggccaccatcgtccacatgtagaaggcagtcagcaacgtgaagtggttctgcctactgcagtctcaccccagacatggaaagcaagagccctgggtggagctgaaggtgctcagctgggtttgtcagaagtctcatctgtcagtgagttgacaagaaacagagcaaaacgactcctccaatgttgacgagcctgcccctgggatttggaaacttcataacagaaaaaaccaatatagacaaaggattttaaacaggattaaggtcaattaagcaaattagaaaaggacacttgaaggagtatttgggacaggggaatcaaaagcaccaggaagacatgaggagtttccctaagactctagactacagcactagcactatgtagataactaacactaaaatattaattatatcattgaaaaaataaaatttacagtgaattacaaactgtttccaaaaggtcatgaaaatcttgtagacttgtttcaattcagacagatgtgttcttctcattctcagctgttcactggtgcatttattttggatttgaccatctggggaatgggtgtggcctctcctggcctctccctccctggggcccaggcagggagaatgtctcagaatgacttccttgagagtcctgctcccctttcatcaatgcacagatacagaagacccctccgtcatgcagcatctgccatgagcatcggcctcctgtgctgtgcagccttgtctctcctgtgggcaggtgggtcctgggcagagccccttgtgtgaatttcaaggcccagcgccttcccattggggctgcagcatcagctttgttctccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagttactccacagcgctacaaggccgtctcctctctgcacataaaggcagggaggttctgccctcctcccccacccaagactcagggatgccctgggcagagatctctgcgccaggaaccttggaacccacagtggccccaagtggcctggacagtatgagccttgctctgtgccaggtgcctctgcaggcatctcagccaggcctggactggtcccaggtcctcagatgtctcctttgttgctttctctggtctatccttggagctttccttttggggtggggccagggctttcccagctcctacttttctactcattatcctgagtccgaggcccccaggataaaacaggatttgcatttcagatccatctagactcccgtctctccctggtgaccctgttgcttcctctctctaatgtttcccccagcccccaccctcatgttttctctcctgtggcccacctttcccatctgggcagtcaccctccaaggcgttgctgggtctctcctccccccacctcctcgcccctctctactgcagccatgaggggagcccctgttctgtgcctccttccttcccatcacagagacttcaaaggccatttcctctgcccttgcatggagccttcctttctgcagtagccagctcctacctgtccttcatatctcagcatgatcaacccctcttgtgggaagcgctccctcccctcccatctgaaatcaactttcctctcataagctgtcacagattcatgtgtctgttagtaacctttagcacagcttggctttctcagatacttgtctggttatttttgtactccacccaatttttaagcccatgagagctaaggctgtgcctgctgcatttaccaacattggtgtctggcatgtagggagacccatttcacaaagaatggatgagtgaatgacaggctgagtgagtgatgagtgggtggataaaccaataataaaaacacactacatctactgtaacctggcagagatctagcattaagtacaagaaagcccatccctttgattgctgggctcaggtcggtcttggaaattgatggggaatcactatcatggcggccacacctggctcaaagcttcctcttgtggttgcagagcctgacctcctccaggtctctgtgctctccttcagggtctttccccacaacaaagcgagacagatcagagatccacttctagaattccatccttaaaggttgttccttgaaaccacttctggtaagaaaatctccattaagtttgcaacaaaacagggccgctacaagtttgagagtgtaacaaatttacgatcagaattagactttatgcatatgtgggaggagctgagaaagagaaggtctggaggagagaagtcagaaggcgagggagccagtcaatagccagggctcctgggggtctcggcaggacaggctggattggcagggacatgaaaggatcagagtatgccaggacatgcagtgggaccttgaaccgggggcacaggaaaaggccaaggaaacctgcttctggggaagctgttcccactctacgggggccacccctgcaggtgcactgccaaaacagcagcctggctgctgtttgccagcatttgggaagatgaactagacacagagtgcagaaggaacaagacttcctaggtctgttggatgcctctgtatctgctggtcacagactctcactgtctgaccacaatgacctgccaagtctaatagtgactgcttttcatctgtcttccaaattttaccaaatgtatccttgaccatctctaacccagaatgataagagaaatggcattctgggaaaggcaggctcttgcctttgcaaagctgacttaactcaattcagcccatgatggattcttccagattaaggcatcagatcacacaactgcctcaacctgccatggtccctggactcttctccatggacatctgtgttgcccaggtgaatgtggacacaatttgtatgtggatgttccagacactggctactaacttttcttttaatcctgtacctgaaatctccctccacccagagggtctataaatgtatgagatttattttttaaaaaatagaaatttgaattctattctgaatctttccttgggactggccagagagcatttttgacctactaacctatattgtgggtgtatttggccccccagagtgcagcagacacttcttgggcccatacatttgcgagttagactggagatgcctgtaaacatgacagattcttggtgttgttccctctcagtcccggcctctctggaatgtcgcagactaccatcaaacaaatagatccccagtatgaagtacataaggacacattaggagttagcaatgaggaaatgtgagcacaagcaacaaacgtttgaagtgcaaacccgaagactcaaaattttggcattataagatatgaaagtttggagagctacatttaaatgaacatgagagggaaaaagagaaacaaggaaaaagagaatgtctgaaaccatcaagtaactttcataaaaattgtcaaataatatatctagaaattcctcatacaaccactgaaaacaaaatggaaagtcaaacagttgattagctgctcctatgtcaaagatggatctgcaggagtgatctagaatgcagcacggaaaattaaaagtggaatatgaaaaagttaaagaacagggaagaaaagaaatggatgtttcccatatattagaatatgcaaatttttcataaattaccatttttttttgcatatgattgcagtttcaaatagataaaataggtagaatgttatgaggtgatatttatgagatgttagctgacaattatttagaggtgtttaaggacctaaattcagagtttccagaatcaaaatgaatctcaagtaagacaaatagtcaagtcatagggaaattgtataacatgagggacaaagagaagattttgaaagcagtcagaaagaaaagacagatacctcccataggaatagatggagaacaacagtaagtcaagatagtggttaaaaataaccattagctcaatcgtcattctccttcattagaggtgagattgattaaaaaaaaaacttttatacgtggaatatgaaaaaccaccactgtgagtttgctaccaagttatcttttctgaattacagttaacaaaggtgggaaatgatcccaaagaaaggcatgagggcagttcatgagggaacgcatgtgaggggacagtcctgttgggcacgtgtgactgggggaatggaggaggctggggcatgaatggggatggcagaggggaccctgacttgcaggaaagacaatgagctcacccttttgtgttctatgttaggggcactgttggtgcatcctacaggacatgcctagcagacagaagagcagctgtgggctggcaagatgaactcagagatgcagcgtgaggcctccgggtccagacagatctggagcccaaagcaatgagccatgcattgatgttgttaaaaaggagcttataaatatttaaagcagcacccaaatgtgttctaatagaaatgctggggccctgaggtcctggggattgacagaggaagtgatgtcactgtgggaaccgccctgtggagacaaggacgtcactcatcctctgctcctgctcatagtgacactgacctggtaaaacccccgtcctggcctgaccctgccatgggcaccaggctcctctgctgggtggtcctgggtttcctagggacaggtgagtccttagaacacaaagtagtttcagtttttttctgtgtgtaggcttgtgtgtgtgtgtgcgatgactacaaatattttccttattctgttgccaaattctatttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagcttagccacagcgtggcacagtcgcctcctttctgctcacaaacctcatccttctctctccttgcagctcctacaaacccttaacagaggcctctctttgctccttacttttcatgggaaaaaggtagatttggacctcagctgtcctttgggtagaaagagaccgcagattcattcctgaaacacagtgagtgcaaatgtaggtggtgaaaacaatcagagcccactgcgctctgggagtcctccgagccagctcactgttccaagcaaggagtcagtgtcttagccttggccttcagggcagacatgcatcttctataggtcttggaggctgctgtgctgcccacatccatgaggttgtcataggcaggaaacacgcctcttcttcatatgttggggcatttggaaggtctgaggctacatccccaggaacatctttcttcagaagcctgttctacccctgtcaccttggaagtttcttcaacaaaatatcaaacatctcttcctataaagtaaacgtctttgcaaatttgtggtccttattaataaatacaatggtgataacaataagacttcacttcttctgcctactttaagccaggtgtatcctttattttgtttgcatttgccattgctactgtcctgatagacagaagcgtgcattcaccaccgctgcccgttcaccttgattccctcaggaaatctaatttctagactctgagggttttcattgctgtcaaactcatttgatttgaaatcattttcctgaggcctttaactcaagaagtgttttatttataatattgaatatatttctttttcttttatttttcatattatattttattatacagtacttgttataaatagaagtacaatgattatattgtaatagaatcttcaactcgtctgtgggtgctgctgcagtttgtatctatgaaagcgaatgcactggtcagagctgatgtgattatggatcatgggtttcagggagtcttcggcatcagaccacttctccaagtctgggactcagtgtcccagatgcagccatgatagaggtgccctgagtctttcatagctgggaggggcatcatagccctcccaaattctctgatcagaaattgtggtggtacagacaccaaatttctttccccagagaatgatgatctctggtagggagctgctctagacccattttttattgtgccatcatcaaatcattccttgctcaggtaccctctgtctcctgggactgagtaaggccagggcacagatgggaattccttgtcttcctagaccttgtctctaactgctgccaccttcctccatgtgactcctgagacacctactcctaacagtggacaagctctgacactgaggctgaacagaacacagtccacaattgtaaccggtgctgcaacaacatgaaacaaaagcaatcaggacttccaacttatacagaaaatgaacatagaagagtagcaaagggcagatattactaatggacaaataggaaggaatcagtttctgctctaatgaaatcattcagttgtcttgagttaagcaggataaacatttcattgcaattacttcaagtcaaatgtagcagctccacaaccaaccagcatagctatttgctttgtgatcttggcagcttcaaaggactcagaaatcctttctctgcacaaacatccctttgtccattccaagacccaggatcacacactctgatcctatcatgaaaacaatgaggtgtgctatacttgctgcggcctcattttttgtgtgttgagtaggaagcactgaagaactttgaaagctttgctcttgagtctagggatgtgctggagccagcttgtatgagtcagaagaaccaaataggcatattactcttcccagctcccaagcagtgaagccatgttggccacttgaaatctaccatggtgggtatgctggtacaaccgaaattaggaaatgctaccagacatgcccccaccttcacagacaccccagtttatcagcacatccctggggtattttctgatgtccctgttatgccatttcttgtggggccaaaagggctcagaattcacctcccctctacttttgttcttagaagccatcacctaagggggcctcgattgttcctatttctattcaacctccagattctcttgctctgtaattctgtgtctcctgcaagcatgccagtctggaacatgacaactattttgaatgtaactaaaggtatcactgaaccagttcattatttacaaattatctttcctcgcatagaatattcagatgctggagtcattggcaacagagatggccaagtagcaactattcttctgtggcaacgagagaccctgtaaaaaggacaattttgctttggagactaagcacctccacaccagtcaggaatgactctgcttttactttaggctgagaggtcagaagggtcagaatactgagggtcagaggccctcagtattctcctttccaagacggagtatggccactctccatctcagtccctggaaggtgtccggagctccctgagaatccctgctctggggcagaatcaccaaggctcatcctcgccagctccccacaggctccagcagggctttcctgccaggtgcagggcacaggaatggctctatctgtctcttggttagagggaggctatgcaatgatgtttgtataagagggactgggattctgggtctccattaaagtatttgataatattttctttgttttttgttttattttgccatctcaccacttaggagagcaatcccttggtagttatattgtttttgcacttggtaaggtttttgtggttaagtcacattaagaaattgtgcctttttttcctgttcagctgtaacccaaggcagtgaaagaaacagcaataattttgaaagcagttacttatgcatcctatgataaaggtgttaagttccattgcccacatctaactttcagtctagtggaaatgaaaaggcacagttagggggcatgtgagcctgccatgagagaggtcaatgccaattgagaagtctgtgccaatccccagtactgtgggattgaaggggagggagagatgacctctccttcagaccatactcaacaaggagggagagggagttcatccatgggaacctgcggagaagcatatcccaggggcatctaactcagggtgcaggagcaaatcattggaaatgaaaatggtccacttcagctgtcacaggagacaggagaaagaaaagtcatacattccacagtcccctggctgattttcttccttatgatagtattttgcaccagcgtgtcctcatctcccgctgctcctctgcctctttcataatcatctcttccctctttgctgctcagatcagtggatgtgcattgtacaagctgatcatttcctgtagcagcacctttgctggtcttacttatgttcatccttattttgtgcattaggtattgctccctccaccattgcttatttccttgtaagaggtctcctttatatatttcaattttactttttattaatagacatttttaacttcatcttttgcttatctatgcttttggggtaacactgtcatttttggagggcatttttgtttatccttagtcattcagattaaataatctctttatacctcaacgtctgtgttttcttactatttaaaaccaaatattgtttcctttcattcctctccttctgttcctctttctttagatggtagttttaagggagaaaaagttagactataactggagctatgtgataagagttattcagaatgagggtgggatattaagattggtaactcaaagcaatagtcagggttagaagtagtgttgggatgagggtttagggaagctgctcataaaacctgcgggatggcacttctggaatattctggcagctcgctctgtagacatttctcagcagtccttgggccattgcagaagaaacaatgatgaaacttcacttattggccacaagatggcactgtggtccactgggaactaaagtactctgggcagtctgggagagcagcctaggagggaaagggttaagaaaaattcgggcttggatcccatattatgcagatgttgcagcagttttcagttattgctaggctacctacagctatgcaagaggcgggaagtccctctaatctttaatgacatctacagttgaagaatgttggctgggcagctttggtgtcagagcaggtgcagacagaggagcaactgcctcagaggaaaaggcgaaagaaaggggccggctgtgccctgagtccagtccatctctgctgcacttcatcttccctgcatgtctctccaggcaacagctttaacctccttgagtgatcagggattctacaagtttataagtcgtactgataacatcaccttggcttagattccattggataccaagcacgtgttctctggagggccaaaaatattgacaacaatttctaaaacacctaagtaaacaaactacagaaggaaaatattagtagatgcaccaaacagtgccgttagacctgaagataatcaatgagtagaattatcaaaaggagactataaataagtctctactaagtatttgtgggcatcgagcagtgtttgagtcctctcagggtagattaaggaaggaattcagctattatcttgactttggcttggatgaaaatccatgacctcctcaattgattttcttgtaaaatattacagaataatattgagcaaacattttatttttctccagcctgtatccctccttagcactaacaggtaaagcgaatacctagaggcaaggtttctttagttgggatccattaactgcaggactgggaggtccatagctaggcttcacagggagtgcaaaccccacgtgcagggaaccccgtgtgtctgtgctgtgcccaactcccctctgtgaggctgccaaagggggactgccgggtctcccaggaccccactcacaaagagggagaaagctgcttgctgggcaaaaaaatcaattcaccaattggccaatctgttgaaagccagaaagaaaagaaacgttcaattgtgagactgatgaatgcccaatttcccaagttataaaatgtatagcagctcatggttctcagaatgatttcaacagcatatgaagatatttttagaaagtttttgtttttctaaagcattccttgatattgatcctcacttgtttttcagcccactcatccgttgagcttaatttgatgccaaatttcaatgttgcctatttcagtcactgaccacttctcacattctccatatcttacacagatacgtgtgttcctgtcttttcttctttttgtgtgatgcatttttaaattgggctgtacagaatacaagcatacatttgtaaatgactgccatcttttatgcagtttagctgtttaatttttagtaacactttttattaaggtataattgagagtaaaacacaagtattaatacaaaaacatcctggtacattttgacaattgcatacaccagtgcaacagtaactgaaatgattataaaaaaaatttccatcactcaagaaagtgtcctcatgctcctttccaatcaatttctatcccagagataaaaacttttctgtttttatcaccattgactagctttgtctattcttcagcttcatataaatggaatcatattttattagttatttttctccaaaattagtatttctgaagtgtattcatattgttgtatcagtaggtcattctttcttatgactaatattccattgcataaatataccacaaattttttgtgcattctcttgttgatggatatccatgttattcctgtcttcaactattatgaataaagttgttgtgaacattcttgtggaaatctttcttttggacatatgcattcttttttcttcttttaaaacctacacttaagagtggaaatactgactcatagtgtagatgtgtgtgctatgcttgcgtgtccccacaaaagctcatgttgaaatttgtcagtggaatggtattgggaggtgggacagctatgactaggtcataagggatctgccctcagaaagaaatcaatgcccttattgggcgagtgacttagttttcccgggaatggtcttccaataaaaaggatgaattcagctgttttctctgtcttaagtgcttgcttccccttccttctgccttggataacagcaggaggacctcaccagctgtggccctttgatcctggacttcccagtctccacatctataagccaaataaacctcttgtctttatacattgcccagtccgtggtatttctctatagcagtaggaaagaaattgaaagaaaatatggcaccatgaggctgttgttataatacctgaaaatgtagaagcagctttggttaatgggaagtggctaatggatagaggttgaaagaattgggaggagcagactagcaaaagcctagactcctgaaaacagagcattaagggcaattctggtgaagtgtcagggggaaatgagggacaagctatcggaaattgaagcaaataccatccttgttataaatagcaaaaaccttggcaaaattgtgtcctgttctaggactttatggaatataaaattatgagccattcactaggatatcaactgaaagaaatatctaagcggcaaagcattcaggctactgtgtgactactttcgggcaccaggaaatttcacccagcaagaagggagccatgggaatagattttgcaaaccagcacagatggtaaccctacctccctctgctgtcctgtctcccataagccaaaccctgtgctgtgagctcttaaaatcctagaattatttctggggaatctatactcttaataatttatagacaacccaggtctgctttggatctgatcagacggactaaatcttggggactctgcaccactggccactgaagaaaggggctgggaatgttgatgggacaggaaaatataataagaaacattggtgtgaatctagtatcagaaagatgatgtgaggacaacaaggaagagctggaatgtgagggtttaatcacaggctcctcaccctccgctgatgggtaggtgtgttagctccagcatggagcaccaccgcactaggtgggggaagggtgagagggcaatggggcagcctgtgagctggggcaacgtaggcagagaaggaactgtgtcaccacagaaacttctgccttcacccatcccttcagctctgcaggacaggtagagactccaggatcatccactgagcactggacataaggaaggctgcatggggaggactcaggacagtgacatcacaggatacccctcctattaggaaaatcaaggcccagaattcactcggctcttccccaggaggaccaagccctgaatcaggtgcagtgctgcctgccccactgtgccatgggccctgggctcctctgctgggtgctgctttgtctcctgggagcaggtgagtcctgggcacaggacagcagccccattctcagctttcccacccatgtcctccactttaccttggggaggacctccaggctttctgctgtgctcatcctccatctgcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcagcttggcacagcccggcagagtctctgacattctatacataaacttcctgccttagctttgacttgagagctgcaggccccacccaggtttcactcctgcaagggaagcttttagttgtatggaaggcatgtgttgtgtcctactgagcacagagctctcccaaacagagcccaggtttcctatgccctgagtgtgccggcttctgtgcagcatcttcttgcagcttgtcacttcctgggtaacttcagtagaagagtgactgcggagccccagatgtgtgctagattctttgaatttgttatatagcttaaagtctttcaacaaccttgcacatcaatcattcttattcttccttgacagatggaagtctcagggacattcagtcattttccccagtgtctcctggcttgtaaggaccagaagtaggaaacaaagtagtgcatccattttccacctacccccctgctccatcatcaccttctgtgtcctggtcagtaagtcagagccctcaaactgccatctagtgaccagcagggcctcactagaggcttacatgtcttcaggggtcattactctggcctcttcattagaaactttgaggaatgttaaatttaacactttttaaaaatcatttatatgcattccctttgtctatccccagtctgcagcctacactttcatttttatggtgttttacacaagtttaatttaatgcaacaataactaaaaacaattttgtttgtgtgtagacaaaaactgctttctcatataaatgtctaatgatatttttctcaatttattctactaaaatttaagtttggattttcaccaataagaataaatgaacctgaaatatatctcatgtgagaaataagatagagacctaggaattggagggaagcacatatgttcagtgaagaagcaatcgtctgtcaaaaagagctctaaagtggacacctcgtgctgacagtggagagataattggaaggcaaattatcatgaaccttgtctgtctattgtcttgtagaagaaagacagccaggagcagagacaacatgggcgaatgtttatgactggacttcaggttgaaggttgcagcaggtagagggaggagttgcaggcagagggcagaatcactagctggcaggggcagtggcatcaccagtgactctactgacatccaggaattatgtccccaacgcacaagctgaaaaacctcccacaattcgccgaattttccctgaccctgccttggccaccagatttctcaatggtgcggccttttacctcctgggggcaggtgagtcccctaaagccttttccttggcttaccacatcctagcctaagcctttaccacaggtctacattattgaggtccctctttgggcactcaacttccttctatcatagacttcatagaatctgggataaccagatcccaagataccagagaacaaaggcaggatgcgaagcaacatggagatgcctaagactgtcatccatgacatgtgtaggtgttaataggagctgaagctggtgcacagctgatccgtcccagcacacactacagagaaattgctgagggtctgtaactttctctcaaagctaaatatgtggccttggtgtcagacagcctctcccagacctctgtgccctcttgcaccagcagtcaccccacagccaccttcctctgcacacaaagctcagtggaagatataggtggcctcgtcttcacgagactgcgatccaggcagcggaagacgttgtcccatagaagtctccccaacactgcccaggctggggccctcagatttctgagcagctctgtgcatgggaaactctgccctgtgctgagcttctcttccaggccagtctcagctggacgacggaatgtactttaccatgatgtgagtggatgcagcctctcttccaggcccctcctgcagctctggcctcagaagtccttttcttcagttattctcgaaaggaaagctcatttgaagttgtatatttgcagacagcattgacaacacaggtctatgttcttttccctgtcagcattcacaactccatcttccccacaccacgctcatatcagtcctcagcctcctccacgtgatgtccgctcccagctgtcctctcccttcctctgcatcctcacctccaggtcaaccacagatgcctcagttcaggccattcctcacgcgtcatgctcctcctaccaaagccctttccactccacgctgtatcctctgggtcaacacaagtctcttcttttttgttcttgctccaaatctcagtttaaccactaccatctctagggatacgctccttcaacagttttcctaggctgcacctccttaatataaatcctcacagctcataatgtgcgttagtattcatagatttaacaccattgtcattttccatgacttcgggtgactaatggactcttctcttgctctctagactgtaaaacgcatcattttagaaattgtggatgttttgttcctgattttatcatcagtacaaacagcggttccaggtgccagtggccaatcttgaaagaataaaggatggatagtgaaaggccctctgggttcccacgtagagtgtttcagaagtctggacgcattaagcgggaacctctatcccttcatctcctaggatctaatgagtcctggaaacagaggagaaatccctgtcatggatgagtaactggatccaagcctttctgcaggactgaatttcctaactgcccaccgccttcctggcttttctcctccaatgtccttccctcacaggtgtcctggatttgggagtctcacagacacagcacacctaatcattggcagagtggtgtgaaatatagcattaaatactggcattaaaaggtgatggaggctgggtgcagtggctcatgcttgtaataccagcactttgggaggtcaaggagggcagatgatgaggtcaggttagcctggctaacatgtgaaaccccaactctactaaaaatacaaaatcaaaattaaccagccgtggtggcagtcgcctatagtcccagctactcagtagactgaggccggagaatggcgtgaaccagggaggtggagctcacagtgagctgagatctcaccagtgtactccagcctgggcgagagagcaagactctttctaaaaaaaaaaagttcatggagaaaaaaacaaagggcttctccattctttgggtggctttgaggccatggtggctgctacactgaactatatcattagtctccatttccatgaattggtgggcaatgccagagacacagagttcatggtcaccagcttcctccagcccacacctgattttggttcagggcactgaagagagacctttgcttgttcccctcctttgccagttaggaaaggctggttgtgaggcagaggctccacatatagagcagggctatgtgttagtccctgaagaattgtgagagccattctgggtggaaataatcaaatatacaatcaccaaggatggcctacagatagaccgaagccccaattttgctggagtgatttgcatctatgctttaaagacaaatgcagttttatctctttaggcaataaagaccaaaaatagactagctattttaaataattgaaccttaaacagaccacagtcagaacatcttccctagggacagcattttcttccacccactcactaaagctctatttgagaaagctgtgtgctgttgataaacactggaatatcgttacaatcgacattgtaataatactgctacttggatcagaaacaaagagcatttctaaagcttgaacaatgtaaaactggaaacgagctctcactgagtttggaaatgcaggcactagagggtgctcatttctcttccttttccaatcaggggctattcaaaggctgttctagaacaaggggtgagatcctccacttccccgtggtgatcaggctttcacaggtagaagccttattagttcataatcagccaagctgacctcaccatcaaatgtatcgacctcgatgcttaccctcctcagcagtcagagactgtctgtgttcaccaggagctcgtgtgcttttacagagcacactttctcctcggtttagtaaaaaaaataaatgggccattatagggggttccataaacagaagctttctgtactttgcccatttagacactacaaattctgatgtctgacgaatagtgtaaacttaaagcttgcatgtggttaagaacttttaataaacaaattaaataatatatataatgaaaatgtcaataatgttctccaatccaatcccaccttccactcataaccaatattaacgctctggtgtgcttcttttcacccctcttttctgtgttcatgcacacctttctacccaagtacacctacagaaaatgggttcacctgtacactttacctgccacatgcatactcttttctgttaatatatcctggtctttattgttccagattggttgatatagatctaacttgctcctattagctgcttcacattgcataatgagggtagacaggtacatttgtgctctattgtctgattcctaaattctgccagatcttttccaaagtgactgaatggcctctttgtgcttccgagttcctctcaccccagcacccagttgatgattccagcgtttccatcactcatagtcctggcaggtttgagagctccattggttcctcctgcatgaggagacagggacggataaaaggatagacctttatcaaacctaacagagactacacggtatctcagttcaacctcataaagcattgaggggaatgttagtcttgttttatagatgagtctagatgaggctagaatccaggaaagttaatgaatggccttgcccacggtctcagagctaataaatggtggaggcagatgaagggcagtcagcctgcttccatgtggaattgatagaggggtcactggactttgacagaggggaagtctagaaccatctggggctgtcttcagatcggacaccagagttaagagagcctgtgtaccctacagcactgcagatagaagcatcatggtgttggcagtggggaggtactagagtgtgtaagtggttagtggcctacaaccagaagacctgagttttgagaaaattattcccatcacaagatgtagcagagacagtgatatggatatactagaccagagagctctgtgaggagctctgtgaggagctgtggcctaatcatgcatcaggccacgtttgtgtccataggtcatgggcagtgctgggtggccaccatcattcatacagagagggcagtcagcagcgtgaggtggttctgcctgctgtggtctcaccccaggcatggaaagcaagagccctgggagcagcggaaggtgctcagctgggcttgtcaggagtctcatctgtcagtggattgacaagaaacagagcaaaatgattcctccaatgttgatgagcctgcccgtgggatctggaaagctaataacagagaaaaccaatatagacaaaggattttaaacaggattatggtcaattaagcaaattagaaaatgatacttgaaggagtatttgggacgcagtagtcaaaaacaccaggaagacatgaggaattgccctaagactctagactacagcactatgtagataactaacaccagactattaattatatcattgaaaaaataaaatttacagtaaattacaaactgtttaccaaaggttatgaaaatcttgtagacttgttttaattcagacaaatgttttcttctcattgtcagctgttctctggcgcatttattttggattgaaccatctggggaagaggcgtggcctctcctgactggaaggctctggggcccaggcagggagaatgaggtctcagaatgacttccttgagagtcctgttcccctttcatcaatgcacagatacagaagacccctccgtcctggagcacctgccatgagcatcagcctcctgtgctgtgcagcctttcctctcctgtgggcaggtgggtcccggacagggccccttgcatagatttcaaagcccagcccctttccattggggctgcagcatcagctgtttccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagttactccacagcgctacaagaccatctcctctctgcacataaaggcagggtggctctgcccttcctcccccacccaagactcagggatgacctgggcagagttttctgcaatggggaccttggaaccccgagtggccctaagtggcccggacagtatgagcctcagtctgtgccgggtgctcctgcagccatctcagccaggcctggactggtcccaggtcctcagatgtctcctttgttgctctctctggtctatcctctgagctctccttttggggttgggccagggcttccccagctcctacttttctactcatcatcctgactccgaggcccccaggatgaaacaggatttgtatttcagatccatctaggctgtcctctccctggtgagcatgctgcttcctctatctagagttttcccctcccccaccccacccatggtctgtcctgtggcctatctttcccatctgggcagtcaccttccatcccccgcctccccgcccctctctactgcagccatggggggagcacctcttctgagactccttccttcccatcacagagacttcaaaggccatttcctctgccctggatggagacttcctttctctagtggccagctcctacctgtgcttcagatctcagaatgatctgccctcccgcaggaagcaatccctcaccgcccagctgagatcaattttcctctcataagctctcatagaatcatatgtctcttagtaacccttaggacaattaggctttctcagatacttgtctgatgatttttgtgctctacccaattttttttttttttctgagacagtctcactctgtcaccaggctggagtgcagtggcatgatttccgcttactgcaacctctgactctgattccagtgattctcctgcctcagtctcccgagtagctgggattacaggcatgtgccaccatgctcagctaattcttttttgtatttttagtagagatgcggtttcaccatgttggccaggatggtctcgatctcctgatctcatgaaccacctgcctcggtctccgaaagtgctgggattacaggcgtgagtcaccgtgcccggcctctccactcaatttttgagcccatgagagctaaggctgtgcctgctgcattaacaacatcagtgcctggcgtgtggggatacccatttcacagagaatggatgagtgaacgagaggctgaatgagtgatgagtgggtggacgaaccaatagtaggaacacactacatctactgtaaactggcagaggtctagcattaagtacaagaaagcccacccctttgattgctgggctcaggtcgatcttggaaattgatggggaatcactatcatggcggccacatctggctcaaggctttctcttgtggctgcagtacctgacctcctccaggtctctgtgctctctttcagggtctttccccacaacaaatctagacagatcagagatccacttctagaattccatccttaaaggttgttccttgaaaccacttctggtaagaaaatctccattaggtttgcatcaataaaacagggccactacaagtttgagagtgtaacagatttatgatcagaattagactttatgcatatgtgggaggagctgaggaagacaaggtctggaggagagaagtcagaaggtgagggagccagtcagtagtcagggctcctgaagctctgggcaggacaggctagagtggcagggacatgagaggatcagagcataccaggacatgcagtgggaccttgagccgggagcacaggaaaaggccaaggaaacctgcttctggggaagctgttccttgtctatgggggccacccctgcaggtgcactgccaaacactgtgggcagcctggctgctgttggccaacatttgggaagatgaactggacacagggtgcagaaggaacaggacttccaaggtctgttggatgcctctgtatctgctggtcactgactctcactgtctgaccacaatgacttgccaattgttatagtgactgttttatatctgtcttctaaattttaccaaatgtatccttgaccatctctaaccagaatgataacagaaatggcattctgggaaagtcagactcttcatttgcaaagttgacttaacacaatccagcacaggatggattctcccagattaaggcatcagatcacacaactgtctcgacctgccacggtccatggactcctctccgggggacacctgtgctgcccaggtgaatgtggacacaatttgtatgtagatgttccagacgctggtgactaacttttcttttaatactgtgtctgaagtctctctcacccagagggtctatatatgtatgagtatatatgtatttataaatatgtatgtgtaatttctccttagaagaaaatgtcatgatgactacatggcttaatggcatttatttatgaaagagctttattaaaaataattagaaaatttgaattctattctgaatttttccttgggagtgtcctgagagcatttttgaccctaccgacttttgtcatgtgtgtatttggcagcctagagtgcagcagttattggcgccatacattagggagttagactggagatggctgcaaaatgactgactcttagtgttattcactctcactctgggcctcactggaatgtcacagactaccatcgaacaaatggattcccagtatgaagaatattaggagatagcaatgaggaaacatgagcacaagcaacaaacatttgaagtgcaaacctgaagactcgaaatgttggcattataagatatgaaagtttggtgagctacatttaaatgaacatgacggggaactgaaactaggaaaaagacaatgcctgaaaccatcaactttcataacaattgtcaaaaaatatatctaggaatgcctcatacaatcactgaaaacaaaatggaaagtcaaacagttgattagctcctcctacagagatttttagtgatttcaaagatggatctgcaggagtgatctagaatgcagcacggaaaatgaaaagtgaaatatgaaagaagttagagaacagggaagaaaaaaatggatgtttcccatatattagaatatgcatatttttcataatttcccattttttgttgcatatgattgaattttcagacagataaaataggtagaatgttatgaggtgatatttatgagatgttagctgagaagttttttgaggtgtttaaggacctaaattcagagtttccagaatcacaatgaatctcaaataaggcagtcaagtcataagcaaattgtagaacatgacggacaaagagaagattttgaaagccgtcagaaagaaaagacaaatacgtcccataggaatagatggagaacaacagtaagttaagacagtggtaaaaataaccattagctcaattatcattctccttcatttaaggtaagattgattaaaaaaaataacttttagaaggggaacatgaaaaatgactgctgtgagtttgctatcaaggtttcttttctgaattacagttaagaaaggtgggaaatgatcccagaagaaaggcatgagggcagttcgtgaggtaacccaagtgatggggctgcccgttgggcacgtgtgactgagggaatggaggaggctggggcataaatggggatggcagaggggaccctgaattgcaggatagacaatgagctaatgccttggtgccttgttttggggatgctgttggcacatcctacaagacatgcccagcagacagaggagtggctgtaggatgagaagatgaactcagagatgcagtgtgagcctctggctccagacagcacgggagcccaaagcaatgagccaggcattgatgttgttaaaaaggagcttataaatatttaaagtgtgttctaatataaatactgtgaccctgacatcctggggattgagagaggaagtgatgttactgtgggaactgccctgtggagacaaggacattcctcgtcctctgctcctgctcacagtgacactgatctggtaaagcccccatcctggcctgaccctgccatgggcaccaggctcctctgctgggtggtcctgggtttcctagggacaggtgagtcctcagaacattaagtagttttattttttctctgtgtgtaggtgtgtgtgtgtttgtgtgtgtgtgtgtgcgatgactacagatgttttccttattctgttgccaaattctatttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagcttagcacagcgtggcacagtcgcgtccttcctgctcacaaacctcatccttctctctccttgcacctcctagagacccttaatagaggcctatctttgatcctcacttttcgtgggaaataagtagatttggacatcggctgtcctttgggtagaaagagaccacagattcattcctgaaacacagtgactgcaaatgtaggtggtgaaaacaatcacgtcccactgccctctaggagtgcttggagccagctcactgctccaaacggagtgggtgtcttagcattggccttcagggcagacatgcatcttctataggtcttggaggctgctgtgttacccacatatatgaggttgtcaagggcaggaaacatgctcttctcctgcatattttggggcatctggaaggtctgaggctacatccccaggaatatctttcttctaaagcctcttctattcctgtcaccttggaaatttttgcaacaaaatatcgaacctctcttcctgtttaaagtaaaggtctttgcaactttcgtggtctttacttgataaatacaatcatggtaacaataagacttcatttcttctgcctactttaagccacttgtatcctttattttatttccatttgccattgctactgtcctgatagacagaagcatgcattcaccactgctgcctgttcacatcgattccctcaggaaatctgatttttagactctgagtgttttcattgttgtccaactcatttgatttgaaataatgttaccgaggcctttaactcaagaagtgttttatttataatattgaatctattcctttttattttatttttcataatagatagtactatatagtacttgttataaatagaagtacaatgattatattgcaatagaatcttccacctatctgtgggtgctgctgcagtgtgtatctgtgaaagcgaatgcactggtcagagctgatgtgattatggatcgtgggtttctgggagtccttggcgacagaccacttctccaagtgtgggactcagtgtcccagatgcaaccatgatagaggtgccctgagtctttcatagctaggaggggcatcatagtccttccaaattcactgatcagaaattgtggtgtggtacagataccaaatttctttctccagagaatgatggtcactggcagggagttgctcttgacccattttttcttgtgtcgtcatcaaatccctccttgctcaggtgccctgtgtctcctgggactgagtaagtccagagcacagatgggaattccctgtcttcctagaccctttgtctaactgctgccactttcctccatgtgactcctgagatagctggtcctaacagtggacaagctctgacactgaggctgaagaaaacacagtctatagttgtcaacggcgctgcaagaacatgtagcaaaaacgagcagggcttccaatttatactgagaatgaacatgcaagaggagcaaagggtagaaggtactaatgaacaaatagcaaggaatgcagtttctgttctaatgaagtcattctgttgtcttaagttaagtaggagaaaactttcacagtaattacatcaagtcaaaggctagcggctccccaaccaaccaacatagctatttgctctgtgatcttggcagcttcagaggactcagaaatcctttctctgcacaaacatccctttgtccattccaagatccaggatcacacactgatcctatcatgaaaacaatgaggtgtgctatagttgctgtggcctcattttagtatgttgagtaggaagcattgacgaactttgaaagctttgctcttgagtctagggatgtgctggagccagcttgtatgagtcagaagaatcaaataggcatacttttcccagctccctgttcagtgaagccatgctgggagcttgaaatctgccatggtgggtatgttggtacaacagaaattagcaaatgctaccagccatgcccccaccttcacagacacccagtttatcagcacatcactggagtattttctgatgtccctgttatgccatgtcttttagggacaaaagggctcagaatttatgtctcctctactctgttcttagaagccatcatctaagggggccttgattgctcccatttctatccagctcccaaattctcttgctctgtagctctgtgtctcctgcaagcacgccagtctggaacatgacaactattttgaatgtaactaaaggtatcactgaaccagttcattatttacaaattatctttccttgcatggaatattcagatgctggagtcattgggaacagagatggccaagcagcaactctgggttgtgaaacacttacagccccgctattcttctgtggcaacgagagaccctgtaaaaaggacaattttgctttggagactaagcagctccccaccagtcaggaatgactctgcttttactttaggctgagaggtcagaagggtcacaccctcaatattctcctctccaagacggagtgtggccactctccatctcagtccctggaagttgtccagagctccccgagaatccctgctctggaggcagaatcaccaaggctcatcctcaccagctccccacaggctccagcagggctttcccaccaggtgcagggcacaggaatggctctgcctgtctcttaggtagagggaggccaaacagtgatgtttgtataagagggactggggttctgggtctcctttaaagtatttgacaaaattttctttgtttttgttttattgtgccatctcaccaatgaggagagcaatcccttggtagttatattgtttttggcacttgggaaggtttttgtggttaagccacattaagaaattgtgcctttacaggaaattatgctgtacaggaaagttcagctgtaacccaaggcagtgaaagaaatagcaataattttgagagcagttacttgggtatctatgataaaggtgttaagtttcattgcctacatctaactttcagtctagtggaaatgaaaaggcacagttagggggcatgtgagcatgccatgagagagatcgatgccaattgagaagtctgtgccattccccaatactgtgggattgaaggggagggagagatgacctctccttcagactgtgctcaacaaggagggagtgggagttcatccatgggaatctgacgaggagcaaatcccaggggcctctaactcagggtgcaggagcaaatccttggagaggaaaatggtccagttcagctgtcacaggagacaggagaaagcaaagtcatctaatccacagtctcccggctgatttgcttccttatgatgctattttgtaccagcgtgtcctcatctcccgctgctcctctgcctgtttcagaatcatctcttccgtgtttggtgctcagatcagtggatgtgcattgtacaagctgatcatttcctgtagcagcccctttgctagtcttagttatatccatccttattttctgcattaggtactgctccctccaccattcattgcttattgccttgtaagaggtctcgttttatatatttcaattttactttttattaatagatatttgacttcatcttttgctgatctatacttttggggtaacattgtcatttttggaggacgatttgtttatctttagtgattcagattaaataatctctttatacttcaatgtctgtgttttcttcctattttaagccaaatattatttcctttcattcctctccttctgttactctttctttagatggtagttttaagggagaaaaagttaaactataactggacctatgtgataagtgttattcagaatgagggtgggatattaagattggtaactcaaagcaataatcagggttagaactaatgttagacttagggtttaagggaagctgctcataaaaccagcgtgatggcacttctggaatattctggcagcttcctctgcagacacttcccagcattccttgggccattacagaagaaacaatgttgaaacttcacgtattggccacaagatggcagtgtggtccactgagctcgaaagggctctggggagtctaggagagcatcctaggagggaaagggttaagaaaaattagggcttggatcctgtattatgcagatgttgcagcagctttcagttattgctaggctacctacagctatgcaagagacgggaagtccctctaatctttaatgacatctacagttgaggaattttggccggggcaaattttggtcaggggcaggtgtagaggagcaactgcctcagaggaaaagggaaaagcgaggggtgggctgtgtcctgagcccagtgcgtctctgctgcacctcatcttccctgcaggtctggccaggcaacagctttaacctgcttgagtgatctggaattctagaagttcagaagtcgtactgataacatcaccttggctgagattccattggacaccaggcatgtgttctctggaggacaaaaaatattgagaacaagctctaaaacacctaagtaaacagactacagaagaaaaatgttagtagatgcaccaaactgtgccgttagacctgatgataattgactagtagaattaccaaaaagagactataaataagtctccactaagtatttgtgttattgagagcagtgtttaagtcttctcagggtagattaaagaaggaattcagctattatcatgactttggcttggatgaaaatccatgaagtcctcaattgattttcttgtaaaatattacagaataatattgagcaaacattttatttttctccagcctgtatccctccttagcactaacaggtaaagcgaatacctagaggcaacgtttctttagttgggatccattaactgcaggactgggaggtccagagctgggcttcacagggagtgcaaaccccacgtgcagggaaccccgtgtgtctgtgctgtgcccaactcccctctgtgaggctgtcaaagggagagggccgggtcacccgggaaccccactcacaaagaggggagcaggctgcttgctgggcaaaaaaatcacttcaccaattggccaatctgttgaaagccaaaatgaaaggaaagtctgaatgtgagagtgatgaatgcccaattttccaagttatgaaatgtatagcagctcatggttgtcagaatgatttcaacagcatataaagatattgtaaacagcttttgtttgtctatagctttccttgatattgatcctcagttgtttttcagcccacgcatcagttgagcttattttgataccaaattttaaagttgccacttcagtcaccaagcacttctcacattctccataacttacagatatgtgtgctcctgtcttttcttatttttgtgtgattcatttttaaattgggctgtacagaatacaagcatacatttgtaaatgactcccatattttatgcaattaactgtttactttttagtaacaattttatttaaggtttaactaatagagataaaaacagaaatattaatacaaggacaacatggtaaattttgacaaatgcatatgccagagcaacggtaactgaaatgattataaaaaaatttccgtcatgcaggaaagtgtcgtcatgctccgttccaatcaatttctatcccacagataaaaacttttcttagttatttatttattttgagacagtctcactctgtcgcccaggctggagcacagtgctgtgatctcagctcactgcaagctctgcctcccgggttcatgccactctgctgcctcagcctccagagtagctgggactacaggcgcccgccaccatgcccggctaatttttgtatttttaatagagacggggtttcaccgtgttagcctggatggtctcgatctcctgacctcgtgatccacccacctcggactcccaaagttctgggattacaggcatgagccacggcgccaggccaaaacttttcttatttttatcaccattgactagcttggtctattcctgcactccgtataaatggaatcatataacatttttattgagttattttcctccaaaattagtatttctgaagtgtattcatattgttgtatcagcaggtcattctttattatgactaatattccactgtgtaaatataccacaacttgtttatccatgctcccgttgatggatatccatgttactcctgtcttcaactattatgaataaaattgttgtgaatattcttgtggaattctttcttgtggatatatggattcttttttttttattttcttttaggtatagacttaagagtggaaatactgactcacagtgtagatgtgtgtgctatgcttgcgtgtccccacaaaagctcatgttgaaatttgtcaatgtaatggtattgggaggtgggacagttatcactaggtcatcagggatctgccctcagaaacagatcaacgccctattgtgggagtgaataagttgtcttgggaatggtcttctgataaaaagtatgaattcagccactttctctgtcttgggtgcttgcttccccttctttctgccttggataatagcaggaggccctcagcagttatggccctttgatcttggacttctcggtctccagatctataagccaaataaatcccttgtctttataaattacccagtctgtggtatttctctacagcagtaggaaagaaattgaaagaaaacatggtgctgagagtggcgctgttgctacaacaaggacctgaaaatgtagaaacagctttggttaatggcaaatgggtaatggatagaggttggaagaattcggagaagcagacaagcaaaagcctagattgctgaaatagatcattaagggtaattctggtgaaggctcagggggaaatgaggaacaagatatcggaaatcaaagtaaatgctatccttgttgtaggtagcaaaaaccttggaaaaattgtgtcctgttctaggactttctggaataaaaatattatgagctattagctaggatatctactgaaggaaatatctaagcagctaagcattcaggctattgtggactactttcaggcaccaggaaatttaacccagcaagaaaggagccaagggaatagattttgcaaaccagcacagatggtgacactacctccctctgctgtcctgtctccaataagacaaactcgctctggagttagagaaaagaggagccagttaacataatacactggggtcagcttctgaaggcagggtggatctgaagggaataacataaactgtccagagcactacgtataggatgaccttgagggtgctgagtcccaagctggctaggtctgtgctatgagctgagaaggccctagaattatttctggggaatctgaactcttgataatttacagacaacacaggtctgctttgattctgatcagatggactaaatcttggggactctgcaccgctggccactcaggaaatgggttgggaatgttgcctgagacaggaaaatatgataagaaacatggtgtgaatctagcatcagaaagatgatgtgaggacagcaaggaagaactgcaacttgaggtttaatcacaggctcctcatcctcccctgatgggcaggtgtgtgagctccaggatggagtaccacagcactaggtgggagaagggtgatagggtggtggggctgcctgtgagctggggcagtgtaggtagaggagcaactgtatcaccacagaagcttctgccttcacacattcctccagctctgcaggacaggttgagtccagggtccgtagtgcgctagacttaaggaaggctgcatggggaggacacaggacagtgacatcacaggatacccctcccatcaggaaaatcaaggctcagaactcactgggttcttccccaggaggaccaagccctgaatcaggtgcagtgctgcctgccccactgtgccatgggccctgggctcctctgctgggtgctgctttgtctcctgggagcaggtgagtcctgggcacaggacagcagccccattctcagcttttccacccgtgtcctccactttaccatggagaagacctccaggctgtctcctgagctcatcctccatctgcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcagcttggcacagcccggcagaatcactgacattctgtatataaacttcctgccgtaactttgacttgagagctgcaggccccacccaggtttcactccttcaagggaagcttttagttgcttggaaggcatgtcttgtgtcctactgagggcagacctttcccaaccaatagagcccaggtttcctgtgccctgagtgtgcctgcttctgtgctgcatcttcttgcagcttgtcccttcctgggtaacttcagtataagagtgactgctgagcgcttggtgtgtgctagatttttgtatatgttacatatcttaaagcttttccacaaccttgcaaatcaaacattctcatccttcctttacagatgggaggctcagggacattgagtcattttccccggtgtctcctggcttgtaaggatcagaagtgggaaacaaactagtccatccattttccacctacccccctgtttcatcaccaccttctgtatcctgttcagtaaaccagagccctcacactgccctctagtgaccagcagggccgcagcagaggctcagatgtcttcagggggttattactatggcctcctaattagcaattttgaggaatgttaaatttcacactttttaaaaaatcatttatatgcattccctttatctttcccatgtctgtagcttacattttcatttttatggtgttttttgatgtacaagagtttaatttaatgccacaaaaatgaaaaacaattttgtttgtgtgtagacaaaaacttctttctcatataaatgtctaaacatatttttcttaatttattctagtaaaatttaagtttggcttttctccattaagaagaaatgtacctgaaatatatctcacgtcagaaataacatagagacctaggaatgggagggaagcacatatgttcagtgaagaagcaacagcctgtcaaaaagatcccaaaatggacaccctgcgctgacggtggagaggtagctggagggtaaatgatcacgaactttatcaagctgttgttgttagaagagggacagccaggagcagagaccacatgggtgaaggtttatgacttgactctaggttgaaggttgcagcaggtagagggcggaattgcaggcagagggcagagtcactggctggcaggggcagtggcatcaccagtgactctactgacatccaggaattatgtccccaacacacaaagtgaaaaaactcccaacaatctgcacatttttccctggccctgctctggccaccagactcctcagtggtgtggccttttgcctcctgggggcaggtgagatctttaaagacttttccttggctcaccacatcctagcctaagcctttacatcaggtctgcattattggggtccctccttggtcactcaacttccttctatcatagacttcacagatgctggaacaacctgatcccaagataccagagaacaaaggcaggacgcgaagtgacatggagatgcctgagactgccatccatgaatacaggtgcagatgttaataggagccgaagctggtgcacagctgatctgtcccagcccacactacagagaaatccctgaatgtctttgacttcctctcaaagccaaatatgtggccttggtgtcagacagtctctcccagacctctgtgccctcttgcaccaggctttaccccacagccaccttcctctgcacacaaagttcagtggaagatataggtggccttgtctttacgagatcgtgatctgggcagtggaaaacattgtcccataggagtctccccaacactgcccaggctggggccttcagagctcggagcagctctgtgcatatgaaactctgccttgtgttgagcttctctgccaggccagtctcagctggacaaaggaacgcacatcaccatgatgtgagtagatgcagcctctcttccaggcccctcctgcagctctggcctcagaagtcctctttctcaattgctctcaggaaggaaagttcatttgaaattgtatatttgcagacagcattgacaacacaggtctacgtatgtccaatcccatcttccatttgtaacaaatacaaacactgtggtgtgcttcttttcacccctcttttctgtgttcatgcacacctttctacccaagtacacctacagaaattgggttcacctgtacactttactggccacatgcatactcttttctgttaatataccctggtcttattgttccagattggtcgatatagatctaacttgctcctattagctgcttcatattgcataatgagggtagacaggtacattcatgctctattgtctgagtcctaaattctgccaaatcttttctaaagtgactgaatgacctctttatgcttccaagttctcctcaccccagcacccagttgatgaatgcagcttttccatcactcataatcctagcaggtgtgagagctttatcagtttctcctgcatgaggagacagggagagataaaaggatagatgtttatcgaacctaccagagcctacacagtatctcagttcatcctcataaagcatggagaggaatgtgcgtcttgttttatagacgagtctagatgtggctagagtccaggaaggttaatgaatggcattgcccatggtctcagagctaataaatggtggagccagatggaggacagttggcttgcctctgtgtagaactgatagaggggtcactggagtttgagggaggtgaagtctagaaccatctggcgttgtcttcggatcagacgccagggggcagtagagtctgtgtaccctacagcactgaaggtaaaagtatcatggtgttggcagtggggaggtactagagtgggtatgtggttagtggccaggaaccagaagatctgaactttgaaaaaatttttcccatcacaagacgtagcagagacactgatgtggataatctaggccagagaactgtgtgacgagctgttcttaaaatgagggagggaggagaagcaactaagggtcacttcctctacatgaaatggagaggaaaacaatgttaactagaatctcatctgattttagtcagttttgctttgtaagtagttgcaaggtgggacaatttatttttgacattaagtaaacatctatacggcttctttaccttatgaagtctggtggtgaaggcaaaaatggtacggccaatggagtcacagtttgtttaataaataactcagagttcaaatggagactctcatgggccagaaattggtaaatgttcctgcattctaaaattaggaggatcttattttctttgaatcaacagagaaggaagcacaggcagtggggagggacagtagggaactcggcagagtggccacagaatgtggaagacaaaggacatgtaataccaaattctaagctgtgaagttgtgatgcaaccctcctccttctcctaatgtttttcaggtctcagcacagatgcacacctgagggagtaacttctttggaaatgaaggacaaatagctgtgtaataataagtccaccttacaaagcacaactggaaatggaaacaagattatttctaaggccttttctactctaagagtaacttagtagcaagctgagaggtgaggatggggggatgttcatccacacgcaatgagtaccatgaggctctaccatgaagcatatagtcctcagtgtgaatcagagccctaagaagaataatgccctttacattgctttgccctctgccatcctaaacccatcccacccataattaagcagccatggaaatgaagggagccagaaggaatcaaaccctgctgcttggttcagtagacagagggacctgggggcagggtgttggctgggtctaggagaagatgatgagctcagaaaatagacaaggagaaaccccaggggaaagcttgtaaaatcctggaggaatcacaagatatattatttgagctcctttttatttattactaaattaatggcaggaatcccatataaagggatattccttatgaaacatgacatctaaagtacaaacagaggattcttccttaccctaaatcctgccctctctccctgagtctcttacgcatcaggccacctttgtgcccataagtcatgggcaacgcagtgtggtcaccttcatccacacctagaggacagtcagcaaagtgaggtggttctgcctgctgcggtctcaccccagacatggaaagcaagagccctgggtggagctgaaggtgctcagctgggtttatcaggagtctcatctgtcagtggattgacaagaaacagagcaaaacgactcctccaatgttgatgagcctgcccctgggttttggaaacctgataacagagaaaaccaatatagacaaaggattttaaacaggattatggtcaattaagcaaattagaaaaagatacttgaaagaatatttgggacacaggagtcaaaaacaccaggaagacatgaggagtgtccctaagactctagactacagcactgtgtagacaactaacaccagaatattattatattatcgaagtaataaaatttacagtgaattacaaactgtttccaaaaggtcatgaaaatcttgtagacttgtttcaattcagacaaatgtgttcttctcattctcagctgttcactggtgcatttatcttgaatttgaccatctggggaatgggcgtggcctctcctgacaggaaggctctgggggccaggcagggagaatgatgtctcagaatgactcccttgagagtccagttcccctttcatcaatgcacagacccagaagacccctccgtcctgcagcccctgccatgagcctcgggctcctgtgctgtgtggccttttctctcctgtgggcaggtgggtcctgggcagggccccttgtgtggatatcaaggcccagcccctttccactggagctgtagcatcagctttgtccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagttactccacagcgctgcaaggctgtctcctctctgcacataaaggcaagggaaggtgctgccctcctcccccacccaagactcaaggatgccctgtgcagagatctctgcaccaggaaccttggaacccagagtggccccaagtggcccggacagtatgagcctcgctctgtgccacgtgcctctgcaggcatctcagccaggcctggactggtcccaggtcctcagatgtctcccttgttgctctctctggtctgtcctccgaggtctcctttcgggttgtggccagggcttccccagctcctacttttctactcatcatcctgagtccgaggcccccagggtggaagaggatttgtatttcagatccatctagactcctgtctcttcctggtgaccatgttgcttcctctctctagggttttcccagcccccaccctcacgtagtctctcctgtggcccacctttcccatctgggcagtcaccctccaaggccttgctgggtctctcctcccctcacttccccgcccctttctactgcagctataaggggagcctctcttctgtgcctccttccttcccatcaaagagatttcaaaggccattccctctgccctaggctagaggctaccttttctactggccagcgcctacctgtgcttcagatctcagcataatctgcccctcctgcaggaagcactcccccgcctcccagctgagatcaactttccactcaaaagctctcatagaatcatgtgtctgttggtaacctttagcacagttgggctttctcaggtacttgtctgataatttttgtactccacccattttttttccctatttttccttttttttttgagacagagtctcgctctgtcaccaggctggaatacagtggcactacctcggctcactgcaacctccgactctccgactctctggttcaagcgattctcctgcctcagcctcccaagtagctgggattacaggcacacaccaccacacccagctaattctttttggtatttttagtacagacagggactcaccatgttggtcaggatggtcccgatctcctgacctcatgatccacctgccaaggcctcccaaagtgctgggattacaggcatgagccactatgcccagactctccaccgaatttttaagcccatgagagctaaggctgtgcctgctgcatttaccaacatcggtgcctggcatgtggggagacccatttcacagagaatggatgagtgaatgacaggctgagtgagtgatgagtgggtggacgaaccaatagtaggaacatgctacacctactgtaacttggcagagatctagcattaagtacaagaaagcccacccctttgatttttgggctcaggttggtcttggaaattgatggggaatcactaccatggcggccacacctggctcaaggcttcctcttgtggctacaacacctgaactcctccaggtctctgtgctctccttcagggtctttccccacaacaaatccagacagatcagggatccacttctagaattccatccataaaggttgttccttgaaaccacctctagtaagaaaatctccattaggtttgcatcaataaaacagagccactacaaatttgacagtgtaaccgatttatgatcagaattagaccttatgcatatgtaggaggagctgagaaagagaaggtctggaggagagaagtcagaaagtgagggagccagtcagtagccagggctcatggagctctggcaggacaggctggagtggcagggacatgacaggatcagagcatgccaggccatgcagtgggaccttgacctgggagcacaggaaaaggccaaggaaatctgtgtctggggaagctgttccctctgtgtgggggccacccatgtacgtgcactgccaaacactgggggcagcctggctgcttttgggaagatgaactgtacacagggtgcagaaggaacaggacttccaaggtctattggatgcctctgtatctgctggccactgactctcactgtctgaccacagttatctgctatgtgtaatagtgactgttttacatctatcttccaaattttacacaaatgtatccttgaccatctctaacccagaatgataacagaaacgtcactctgggaaggcagactcctacctttgcaaagttgacttaacacaatccagcacaggatggattctcccagattaaggcatcagatcacacaactgtctcgacctgccatggtctgtggactcctctccaggggacacctgtgccgcccaggtgaatgtggacacaatttgtatgtagatgttccagacactggtgactaagttttctttaatcgtgtgcctgaactctcactccacccagaggcagggctctgcctcctgcttctgtctccttcctgagcttccgtcctgctggagttgcatggacatcagaaccctggtcagagtgcagcgacctgtggagacagtgggagggaagctcacctcttgctgtcttcctggacctagttcggttatacccaaagcaacttctctggtctccctttggactctgcagtatcagaaatgtgcttcatgaatttgtagctgatcagctcaatgatttgatggccaacccaaagtgaaatcctaagatctgcagaaattgccggcatttctgtgaagatggcaagaatactgtgtgctagagatgccttctctccatgtagagacctggccccaaaacaagacagagcagagagggccaaagagcccaaaacatgtctcagatggttgaagggcaatttcctaggacaatcctgctgacaaaatttcatccctcctattacacgcctgaccacccttctccccagatcagctgagtacccaggatatcacacatcccagcatcttctaacaagggaaaattcttcacatgccagccttcttcctgcaccacattgactaaccctggaaacttcgcctttccagaaaaaagctgtcttctcttggcccagtctagcccagtaggtttaattcatgatttatgtgaccttttaatttactcagaggagaacatatgatttcagagtaaagaatattcattttactttgtataagttggacctaaacagtaaactgagtacttctcttccatcagtgtcttaaattagacaacggtaaaacaaatctttgatgcaagaactttaggtcctggtgtttttcatatggaagatcccagctatccagtccagggcatggaatagatgagcgttaataagtcactctatgcctgagatggttttctattggcatcttttctgagttacagttaacaaaggtgggaaatgatcccagaagaaaggcacgagggcagttcttgagggaatccatgtgataggacagtcattgggcacgtgtgactgggggaatggaggaggctggagcatgaatggggatggcactggggaccctgacttgcaggaaatgcaatgagctcaccactttgtgccctatgttaggggcggtgttggtgcatcctagagtaaatgtccagcagacaaaggagcaagaagcggctgtgggatgacaaggataaactcagagatacagcatgagacctccgggtccagacagctctggagcccaaggcgatgagccatgcattgatgttgttaaaaaggagctgataaatatttaaagcagcacccaactgtgttctaatagaaatgctgtgatcctgaggtcctggggattgagagaggaagtgatgtcactgtgggaactgccctgtggagacaaggacatccctcatcctctgctgctgctcacagtgacactgatctggtaaagccctcatcctgtcctgaccctgccatgggcaccagtctcctatgctgggtggtcctgggtttcctagggacaggtgagtcctcagaacacaaagtagtttcatttttttttctgtgtgtaggcgtgtgggcgtgtgtgtgtgtgtgtgtgtgtgtgtgtgtgtgtgtgtgctgacgacaaatgttttccttattctgttgccaaattctatttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagcttagccacagtgtggcatagtcgcctccttcctgttcacaaacctcatccttctctctccttgcacctcctagagacccttaacagaggcctctctttgctcctcacttttgatgggaaagaagtagatttggacatcggctgtcctttgggtagaaagagaccacagattcattcctgaaacacagtgactgcaaatgtaggtggtgaaaacaatcacgtcccactgccctctaggagggctcggagccagctcactgctcgaaacagggagtgggtgtcttagccttggccttcagggcagacatgcatcttctataggtcttgggggctgctgtgctgcccacatacatgaggttgtcatgggcaggaaacatgcctctttttcatatgttggggcatctggaaggtctgaggctacatccccagtaacatctttcttctgaagcctcttctatccctgtcaccttggaagtttctgcaacaaaatatcaaacctctcttcctgtttgaagtaaaggtctgtgcaacttttgtggtccttacgtgataaaagcaatcatgataacaataagacttcatttcttctgtctactttaagccaagagtatccttcattttgtttccatttgccattgctgctgttctgatacacacaagcatgcattcaccactgctgccggttcaccttgattcgctcagcaaatctgattattagactctcgagtgttttcattgctgtcaaactcatttgatttgaaataagtttcctgaggccttgaactcaagaggtgttttacttataatattgaatctattcctttttaattttcacattatatattgttatatagtacttgttataaatagaagtacaatgattatattgcagtagaatcttccacctatctgtgggtgatgctgcagtttgtatccatgaaagtgaatgcactggtcagagatcatgtgatcatggatcatgggtttctgagagtcctcagggacaggccatttctccaagtgtggggactcggtgtcccagatgcaaccctgatagaggtgccctgagtctttcatagctaggaggggcatcatagtccttccaaattcactgatcagaaattgtggtggtacagacaccaaatttctttccccagagaatgatggtcactgaggtggagttgctctggacccattttttcttgtgtcatcatcaaatcgcttcttgctcaggtgccctgtgtctcctgggactgagtaaggccagcacacagatgggaattccctgtcttctgagaccttctctctaactgctgccactttcctctccgtgactcctgagacacctggtcctaacagtggacaagctgtgacactgaggctgaacagaacacagtccactgttgtaaatggcgctgcaagaacttgtagcaaaagtgagcagggcttccaatttatactgagaatgaacatgcaacaggagcaaggggcagatgtttctaatgaacaaataggaaggaatagggtttctgctttattgaaatcattctgttgtcttaagtaaagcaggagaaacatttcattgcaattactctaagtcaaaggctagcagctcccaaccaaccagcataactctttgctctgtgatctcggcagcttcagaggactcagaaatcctttctctgcacaaacatccctttgtccattccaagattcaggatcacacactgatcctatcatgaaaacaatgaggtgtgctatagttgctgtggcctcatttttagtgtgttgagcaggaagcattgaagaactttgaaagctttgctcttgagtctagggatgtgctggagccagcttgaatgactcagaagaaccaaataggcatactactcttcccagctcccctttcagtgaagccatgttggctgcttgaagtctgtcatggtgggtatgctggtacaccacaaattgggaaatgctaccagccatgcccccaccttcacagacacccagtatagcagcatatccctggggtattttctgatgtccctgttatgccatttcttgtggggccaaaagggctcagaattcacctcccctctactcctgctctgagaagccatcatctaagtgggcctcaattgtacctatttctattcgacctctaaattctcttgctctgtagctctgtgtctcctacaagcatgccagtctggaacatgacaactattttgaatgtaactaaaggtatcactgaaccagttcattatttgcaaattatctttccttgcatggaatattcagatgctggagtcattgggaacagagatggccaagcagcaactctgggttgtgaaccacatacagccccgctattcttctatgtcaccgacagaccctgaaacaaggactattttgctttggagactaagcagctccccaccagtcaggaatgactctgcttttactttaggctgagaggtcagaaggatcatgccctcagtattctcctctccaagacagagtgtggccactctccatctcagtccctggaagttgtccagagttccctgagaatccctgctctgggacagaatcaccaaggctcatcctcaccagctcccaacaggctccagcagggctttcctgccaggtgcagggcacaggaaatggctctgcctgtctcttagttagagggaggccatgcaatgatgtttgtataagagggactgggattctgggtctccattaaagtatttgataacattttctttgtttttgttttatttggccatctcaccaattaggacagcaatccctttacagttatattgttcttggcacttgggaaggtttttgtggttaagtcacattaagaaattgtgcctttttttcctgttcagatataacccaaggcagtgaaagaaacaacaataattttgaaagcagttacttatgcatcctatgataaaggtgttaagtttcattgcccacatctaactttcagtctagtggaaatgaaaagtcacagttagggggcatgtgagcatgccctgagagaggccgatgccaattgagaagtctgtgccaatccccaatactgtgagattgaaggggagggagagatgacctctctttcagaccatgctcaacaaggagggagagggattttcatccatgggaagctgaggaggagcaaatcccagggtcctctaactcagggtgcgggaacaaatccttggagaggaaaatggtccagttcagctgtcacaggagacaggagaaagcacagtcatctaatccacagtcccctggctgatttgcttccttatgatgctattttgtaccagcatgtcctcatctcccgctgctcctctgcctgtttcagaatcatctcttccgtgtttggtgctcagatcagtggatgtgcattgtacaagctgatcatttcctgtagcagcccctttgctagtcttagctatatccatccttagtttctacattaggtactgctccctccaccattgcttattgccttgtaagaggtttcattttatatatttcaattttactttttattaatagacatttgacttcatcttttgctgatctatacttttggggtaacattgtcattttaggaggatgtgtttgtttatctttagtgattcacattaaataatctctttatacctcaacgtctgtgttttcttactatttaaaaccaaatattattttctttcattcctctccttctattcctctttctttagatggtagtttaagggagaaaaagttaaactataactggagatatttgttaagagtttttcagaatgacggtgggatattaagattttggtaactgaaagcaatagtcagggttagaactagtgttggtatgatgatttagggaagctgctcataacacctgcgggacggcacttgtggaatattctgccggctcactcagcagacacttcccagcggaagaaataatgatgaaacttcacttattggccacaagatggcactatggtccactgggctctggggagtctgggcgagcagtctaggagggaaagggttaagaaaaattagggcttggatcccatattatgcagatgttgcagcagttttcagttattgctaggctacctacagctatgcaagaggcgggaagtccctgtaatctttagtgacatctacagttgaagaatttttgccttcgtatcaggggcgggtgcagaggagcaaatgcctcagaggaacattggaaattgtctgaccaggcaacagctttaacctgcttgagtgatctgggattctgcaagttcataagtcttactgataacatcaccttggctgagattccattggacaccaagtatgtgttctctggagggcaaaaaatattgagaagttctaaaacacctaagtaaacagactactgaaggaaaatgttagtagacacatcaaactgtgctgttagagctgaatataattgactagaagaattatcaaaaatagactataaataagtcactactaaagtatttgtgggcatagaacagtgtttgagtcttctcagggtagattaaggaagaaattcagctattatcctcatgaccttggcttggatgaaaatgcatggactcctcaatttattttcttgtaaaatgttacagaataatattgagcaaacattttatttttctccagcctctatccctctttagcacttacaggtagagcagacacctagacgcaaggttttttagttgggatccattaactgcaggactggagatccacagctgggctttacagggattgcaaaccccacatgcagggaaccccgtgtgtctgcgctgtgcccaactcccctctgtgaggctgccaaaggcggagggccgggtgtcccaggaccccactcacaaagaggggagcaggctgcttgctgggcaaaaaaatcacttcaccaattggccaatctgttgaaagccaaaaagaaatgaaagtctcaattgtgagactgatgaatgcccaatttcccaagttatgaaacggatagcagctcatggttctcagaatgatttcaacagcatatgaagatatttttagagagcttttgtttgtctacagctttccttgatattgatcctcacttgtttttcagcccactcatcacttgagcttattttgtggccaaatttcaatgttgtctatttcagtcactgagcacttctcacattctccaaatcttacacagctatgtgtgttcctgtcttttcttctttttgtgtgattcatttttaaattgggctgtgcagaatacaagcatacatttgtaaatgactcccatcttttatgcaatttagctgtttaatttttagtaatactttttattaaggtataattaatagagagtaaaacacaaatattaatagaaggacatcctggtacattttgacaaatgcatacgccagtgcaatagtaactgaaatgattataaaaaaaatttccgtcactcaagaaagtgtcatcatgctcctttctaatcaatttctatcccagggataaaaacttttctatgtgtatcactgttgagtagctttgtctattcttgagcttcatataatggaatcatatttttattgaattgtttttctccaaaattagtatttctgaagtatattcatatcgttgtatcagtaggtcattcttatgactaatattccattgcataaatatactacaacttgtttatccatgctcctgttgatggatatccatgttactcctgtcttcaactattatgaataaacttgttgtgaacatttttgtggaattcttcctgtggacatatgcattttttttaaagaaatagacttaagagtggaaatactgactcatagtgtagatgtgtgtgctatgcttgcatgtcctcacaaaatctcatgttgaaacttgtcaaggtaatggtattgggaggtgggacagctatgactagggtcatgagggatctgccctcagaaacagatcaatgccctttattgtgggagtgaattaattatcttgggaatggtcttctgataaaaaggatgaattcagtcattttctctgacttcggtgcttgcttccccttccttctgccttggataacagcaggaggccctcagcagttattgcccttctatcttggacttctcagtctccagatctataagccaaataaaactattgtctttataaattgcccattccatggtatttctctatagcagtaggaaagaaattgaaagaaaatatggtacctgagagtgaggctgttgctataatacctgaaaatgtagaagcagctttggttaatgggaagtggctaatggatagaggctgaaagaattgggaggagcagactagcaaaagtctagattcctgaaaacagagcataaagggcaattctggtgaaggctcagggggaaatgaggaacaaggtattgaaaatcgaagtaaatgccatccttgttgtaagtagcaaaaaccttggcaaaattgtgtcctgttctagaactttatggaatataaaaattatgagccatttgctagtatatctgctgaaagaaatatctaagaggcaaagcattcaggctactgtgtgactacttttagccaccaggaaatttaacccagcaagaagggagccatgggaatagattttgcaaaccagcacagatggtgactctacctccctctgctgtcctgtctcccataagccaaactctgtgctgtgagctgttaaagtccaagaattatttctggggaatctgtactcttaataatttacagacaacacaggtctgctttggatctgatcagacagactaaatcttggggactgtaccagtggccactgagaaaaggggctcggaatgttgtcttggatagaaaaatataataagaaacattggtgtgaatctagcatcagaaagatgacgtgaggacagcaaggaagagctggaaactgaggtttactcacaggctcctcaccctccgctgatgggcaggtgtgtgagctccagcatggagcaccacagcactaggtgggagaacggtgatagggtgatggggcagcctgtgagctggggcagtgtaggcagaggaggaactgtatcaccacagaaacttctgccttcacacatccctccagctaggcaggacaggtagagagtccagtgtcctggagcactagacctaaggaaggctgcatggggaggacaaaggacagtgacatcacaggatacccctcccatcaggaaaatcaaggcccagaactcactcggctcttccccaggagaaccaagccctgaatcagatgcagtgcttcctgtccctctgtgccatgggccccgggctcctctgctgggcactgctttgtctcctgggagcaggtgagtcctgggcacaggacagcagccccattctcagctttcccacccctgtgtcctccactttaccttggggaggacctccaggctgtccctgtgctcatcctccatctgcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcagcttggcacagcccatcagagtcactgacgttctgtatataaacttcctgccttagctttgccttgagagctgcaggccccacccagatttcactccttcaagggaagcttttagttgtttggaaggcatgtcttgtgtcctactgagggcagagctctcccaaccaataaagcccaagtttcctgtgtcctgagtgtgcccacttctgtgctgcatcttcttgcagcttgtcacctcagtacaagagtgactgctgagccccagatgtgtgcttgattatttgcatttcttacatagcttaatgcctttcaacaatcttgcacatcaaacattcttattcttcctttacagatagaaggctcagggacattgagtcattttccccaatgtctcttggcttgtaaggatcagaagtaggaaacaaactagtccatccattttccacctacccccctgctccatcatcatcttctgcatcctggtcagtaaatcagagccctcacactgccgtctagtgaccagcagggccgcagtagaggctgaaatgtcttcaggggtcattactatgtccttttcattagctcctttgaggaatgttaaatttcacacattttaacaatcatttatatgcattccctttgtctttccccagtctgcagcttatattttcatttttatggagtttttggtgcacaagagcttaatttaatgcaacaaaaactaaaaacaattttgtttgtgtgtagacaaaaaccactttttcatataaatgtctaagcatatttttctcaacttattctactaaaatttaagtttggattttcaccactaagaataaatgtacctgaaatacatctcatgtaagaaataagatacagacctaggaatgggagggaaggacatatattcagtgaagaaacaatagcttgtcaaaaagagccctaagtggacacctggagctgacggtggagaggtaggtggagggcaaatgagcatgaactttgtcagtctattgtcttgtagaagaaagacagccaggagcagagaccatatgggtgaaggtttatgacttgactgtaggttgaaggttgcagcaggtagagggagaattgcaggcagagggcagagtcactggctggcaggggcagtggcatcatcagttgactctactgacatctaggatttatgtccccaacacacaagctgaaaaacctccccacaatttccccatttttccctgaccctaccatgaccaccagactcctcagtggtgtggccttttgcctacttggggcaggtaagatctttaaagccttttccttggctcaccacatcccagcttaagcctttacctcaggtctccattattggggtccctccttgggcactcatcttccttctatcataaacctcacagaagctgggacaatcaaatccttaagataccagagaacaaaggcagtacatgaagtggcacggagatgcctgagactgtcatccatgactacatgtgtaggtgttaataggagctgaacctggtgtacagctgatctgtcccagcccgcaatacagagaaatccctgagggtctgtgactttctctcaaagccaaatatgtggcctttgtgtcagcctctcccagacctctgtgccctcttgcaccagcagtcaccccacagccaccttcctctgcacacaatgttcagtggaagatataggtggccttgtcttcacgagaccatgttctaggcagtggaagacgttttcccataggagtctccccaacactgcccaggctggggccctcagatttctgagcatccctgtgcatgggaaactctgccctgtgttgagcttctctcccaggccagtctcagctggacgagggaacgcacatcacagtgatgtgagcagttgccgcctctctcccaggcccctcctccagctctggcctcagaagtcctcttcttcacttgctctcagaaaggaaagttcatttgaaattgtatatttgcagacagcattgacaacttttccccgtcggccttcacaactccatcttccccacaccatgctcatgtcagtcctcagcctcctccacatgatgtctgctcccagctgtcctctccctctgcaccttcacctccacgtcaaccacagatgcctcagttcaggacattcctcatgcatcatgctcctcccaccaaaggcctttccactccatgctgtattctctgtgtcaacacaagtctcttcttctttgttcttgctccaactgtcagtttatctacaaccatctctagggagacactccttcaacagttttcctaggctgcacctccttattgtaaatgctcacagcttataatatgtattaaaattcatagatttagcaccatagtcattttccatgactttgtgtgactatttaattgacactactcttgcattctagactgtaacatgcatcattttacaaattgtggatgttttgttccccattttattgtcaggaccaacagcagttccaatcttgaaactggccaatcttgaaaaatgaagagcagatattgaaaggccgtctgagtacccacttagatgtctggacgcattaaatcggaacctctatcccttcatctcctaggatcaaatgagtcctggaaacagatgagaaatccctgtcatggataagtaactggatccaagcctttctgcacgactgaatttcctatctgccctatcgccttcctgcctaatctcctccttcaatctccttccctcacaggtgtcctggatttgggagtctcacagacacagcgcacctaatcactctgagagagtgatcagaaacataatgtcaaacactgacattaaaaggtcatggagaagaaaacaaatggcttccccatgctcttatggagagttttcccaaggcacaaatatctctttgggtggctttgaggtcatggtgcctgacacactgagcgatattatgggtgtccatttccatgaattggtgggcaatgtcagagacacagagttcatggtcaccagcttcctccagcccacacctgattttggtgcagggcgctgagcagagacctttgcttgttaccctcctttgccagttaggaaaggctgattgagaggcagaggctccatttacagagcagggctatgtgttagtccctgaagaattgtgagagccattctgggtggaaataatcaaatatacaatccccaagaatggcccacggatagacagaagtcccaattttgccagaatgatttgcatctatgctttgaagacaaatgcagttttatctctttaggcaataaagaccaaaaatagactagttattttaaataattgaaccttaaacagaccaaagtcagaacatcttccctagggacagcattttcttccacccactcactaaagctgtatttgagaaagcagtgtgctgttgataaacgctggaatatcgttacaatcgacattgtaataatactgctacttggatcagaaacaaagagcatttctaaagcttgaacaatgtaaaactggaaacgagctctcactgagtttggaaatgcaggcactagagggtgctcatttctcttccttttccaatcgggggctattcaaaggctgttctagaacaaggggtgagatcctccacttccccgtggtgatcaggctttcacaggtagaagccttattagttcataatcagccaagctgacctcaccatcaaatgtatcgacctcgatgctcaccctcctcagcagtcagagactggctgtgttcaccaggagctcgtgtgtttttacggagcacactttctcctcggtttattaaaaacaaatgagcctttatacggggttccataaacagaagctttctgtactttgcccatttagacactgcaaattctgatgcctgatgaaaagtgtaaacttaaagcttgcatgtcgttaagattttttaataaccaatttaaataatatatataatgaaaatgtcaataatgctctcgaatccaatcccatgttccattggtaaccaatattaacgctctggtgtgcttcttttcacccctcttttctgtgttcatgcacacctttctacccaagtacacctacagaaaatgggttcacctgtacactttaactgccaaatgtgtactcttttctgtatatcttggtctttattgttccagattggttgatatagatctaacttgctcctattatctgcttcatattgcataatgagggtagacaggtacattcatgctgtattgtctgtttcctaaattctgccagatcttttctaaagtgaccaaatggcatctttacgcttccaggttctcctcaccccagcacccagttgatgattccagcttttccatcactcatagtcctggcaggtctgagagctccatttggtttctcctgcatgaggagacagggagggataaaaggatagacctttatcaaacctaccagagactacatggtatctcagttcatcctcataaagcattgaggggaatgctagtcttgttttatagatgagtctagatgaggctagagtccaggaaatcaataaatagccttgcccatggtctcagagctaataaatggtggaggcagatgaagggcagtcggcttgcttccatgtggaattgatagaggggtcactggagtttgagggaggggaagtctagaaccatctggcgttgtcttcagatcggacaccagggttgagacagtctgtgtaccctatagcaccgcaggtacaagcatcatggtgttggcagtggggagatactagagtgggtaagtgattagtggcctggaactggaagatctgagctttgacaaaattattcccatcacaacatgtagcagagacactgatgtggataaactaggtcagggagctgtgtgaggagctgttgttaaaataagggagggaggagaagcaactaagtggtcacttcctaacatgaaatgtagaggaaaccaatattaactagaatccatctgattttagtcagttttcctttgtaagtatttggaaggtgggataatttattttcaaggttaagtaaacatctatacatctcctttatcttttgaagactggtggcgaagcgaaaaatggcacggccaatggagtcagagtttgtttaataaatatctcagagttcaaagagagactctcatgggccagaaattggtaaatgttcctgcattctaaaattaggaggatcttattttctttgaatcaacagagaaggaagcacaggcagtggggaggaacagttgggaacacggcagagtggccgcaggatgtcaaagacaaaggacatgtaatatcaaattctaagctgtgaagctgtgatgcaaccctccaccttctcctaatggattttttaggtctcagcgcagatgcacagctgagggagtaatttctttggaaatgaaggacaaatagctgtgttaaatattaataacaagtccacattacaaagcacgcctggaaatggaaacaagattatttctaaggccttttctactctaagagtctctaacttggtggcaaggtgagaggtgaggttggggtgggtgttgatccacacgcgatgagtaccatgaggctctaccatgaagcatgtagttctcagtgtgaatcagagccctaagaagaataatgccctttactttgttttgtcctgtgccatcccaaacccactccacccataattaagcagccatggaaatgagggtagccagaaggaatcaaaccctgctgcttggttcagtagacacagggacctgggaggagggtgttggctgggtcaaggagaagatgatgagctcagaaaatagacaaggagaaaccccagtggaaagcttgtaaaactctggatgaatcacaagatatgttattagagctcctttttattactaaattttatttattactaaattaatggcaggaaccctgcacaaagggatattccctatgaaagatggcatctcaaataaaaacagagcattcttccttaccctaaagtctgccctttctccccaagtccctcatgcatcaggccacctttgtgcccacagatcatgggcagcgctgggtggccatcatcatccacacagagagggcagtcagcagcatgagctggttctgcctgatatggtctcaccctaggcatggaaagcaagagacctgcgttgagctgaaggtgctcagctgggtttgtcaggagtcccatctgtcagtgaattgacaagaaacagagcaaaacgactcctgcaatgttgagaagcctgcacctaggatctggaaacttgataacagagaaaaccaatatagacaaaggattttaaacaggattatggtcaattaagcaaattagaaaaggatacttgaaggagtatttgggatacaggaatcaaaaacaccaggaagacatgagaagtttccctaagagtctagactacagcactgtgtagataactaacatcagaatattaattatattattgaagaattaaaatttacattgaattacaaactctttacaaaaggtcatgaaaatcttgtagacttgtttcaattcagacaaatgtgttcttctcattctcagctgttcactggtgcatttatcttgaatttgaccatctggggaatggcgtggcctctcctgactggaaggctctggggcccaggcagggagaatgatgtctcagaatgactcccttgagagtcctgttccccttttatcaatgcacagacccagaagacccctccgtcctgcagcccctgccatgagcctcgggctcctgtgctgtgcggccttttctctcctgtgggcaggtgggtcctgggcagggcccttgcgtggatttcaaggcccatcccctttccactggggctgcagcatcagttttgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagttactccacagcgctacaaggttgtctcctctctgcacataaaggcagggaggctctgccctccaccccgacctgagactcagggatgacctgggcagagtattctgcaacgggaaccttggaacccgaagtggccccaagtggcccagacagtatgagcctcgctctgtgccaggtgcctctgtaggcatctcagccaggcctggactggtcccaggtcctcatatgtctcctttgttgctctctcctacaagctctacttttggggttggggccagggcttccccagctcctacttttctactcatcatcctgagtccaaggcccccaggatgaaacaggatttgtatttcagatccatctagactcctgtctctccctggtgaccatgttgcttcctctctagggtttcccccagcccccaccctcctgtggcccacctttcccacctccgcagtcatcctccaccccccacttccctgcccctctctactgcagccatgaggggagcacctctctgtgactccttccttcccgtcacagagacttcaaaggccattttctttgccctgggccagagccttcctttctctagtggccagctccttcctgtgcttcagatctcagtatgatcagcccctctgcgggaagcactccctcccctcccaggtaagatcaactttcctctcataagctctcaatgaatcatatgtctgttagcaacctttagcacagttgggctttctcagatgcttgtctgattatttttgtgctccacccaatttttttttttttaagacacagtctcactccgtcaccaggctggagtgcagtggcatgatctctgctcactgcaacctctgatactctgattcaagtgattctcctgcctcagcctcccgagtagctgggattacagacatgtgccaccacgcccagctaattcttgtttgtatttttagtagagatggggttttaccatgttggccaggatggtctcgatctcctggcctcatgatctgcccttctcggcctcccaaagtgtggggatacaggcgttagcagcacgcctggcctctccacccaatttttaagcccatgggagctaagactgtgcctgctgtatttaccaacatcggtgcctggcatgtggggagacccatttcacagagaatagatgagtgaatgacaggctgagtgagtgatgagtgggtggacgaacaaatagcaggaacacgctacatctactgtaacctgccagagatctagcattaagtacaagaaagcccacctctttgattgctgggctcaggtcggtcttggaaattgatggggaatcactatcatggcggccacacctggttcaaggcttcctcttgtggctgcagcacctgacctcctccaggtctctgtgctctccttcaggatctttccccacaacaaatctagacagatcagagatccacttcaagaattccatccttaaaggttgttccttgaaaccacttctggtaagaaaatctccattaggtttgcatcaataaaacagagccactacaggtttgtgagtgtaaaagatttatgatcagaattagactttatgcatatgtgggaggagctgaggaagacaaggtcttgaggagagaagtcagaaggtgagggagccagtcagtagccagggctcctggagctcgggcaggacaggctggagtggcagggacatgagaggatcagagcatgccaggccatgcagtgggaccttgagccgggagcacaggaaaaggccgaggaaacctgcttctggggaagctgttccctctgtgtgggggccatgctgcgggtatagtgccaaacactgggggcagcctggctgctgttgggcagcatttggcaagatgaactggacacagggtgcagaaggaacaggacttcctaggtctgttggatgcctctgtatctgctggtcactgactctcactctctcaccacaatgacctgccaattgttatagtgactgttttgtatctgtcttctaaatgttacaaaatgtatccttgaccatctctaacccagaatgataaatggcattctgggaaagtcagactcttacatttgcaaagttgacttaacacaatccagcacagtatggattctcccagattaaggcatcagatcacacaactgactcaacctgccacggtccgtggactcctctccgggggacacctgtgctgcccaagtgaatgtggacacaatttgtatgtagatgttccagacactggctactaaattttcttttaatcctgtgcctgaaatctcgctccacccagaggcagggctctgcctcctgcttctgtctccttcctgagcttctatcctgatggagttggatggacatcagacgcctggtcagagtgcagtgacctgtggagacagtaggagggaagctcacatcttgctgccttcctccatccagttcttttataaccaaagcaagtgttctggtctcccttttgactgtgcagtatgagaaatgtgcttcatgaatttgtagctgatcagctcaatgatttgatggccaacctaaagtgaaatcctcagatctgcagaaattgccctgcatttctgtgaagatggcaagaatacagtgtgctagagttgccttctctccaagtagagacctggcccccaaacaggatggagcagagggggccaaagagcccaaaacatgtctcagattgttgaaaggcaatttcccaggacaatcctactgatgacatttcatcccttgtattacacacttggccacccttccccccagatcagctgagtacccaggatatcacacatcccagcatcttctaacgaggaaaaatacttcacgtaccagcctccttcctgcaccacattgactaaccctggaaacttagcctttccagaaaaaagctctgtcttctcttggcccagtctagcctggtaggtttaattcatgatttatgtgaccttttaatttactcaaaggagaacgtatgatttcagggtaaagaatattcattttatttttataagttggacctaaacagtaaactgagtacttttcttccatcagcgtcttaaattagacaacggtaaaacaaatctttgatgctagaacttcagatcctagtgtttttcacatggaagttcccagttacccagtctagggcatggaatagatgagcattaataagtcactgtatgcctgagatggttttctatgggcatcttttctgaattacggttaacaagggtgggaaatgatcccagaagaaaggcatgagggcagttcttgagggaacccatgtgatgggacagtctcattgggcacgtgtgactgggggaatggaggaagctggggcatgattgggatggcacaggggaccctgacttgcgggaaagacaatgagctcaaccctttgtgcccctatgttaggggcgctgttgttgcatcctacaggacatgcccagcaggcaggggagcggctgtaggatgagaagatgaactcagagatgcagtgtgaggtctccaggcacagacggctctggagcacaaaccaatgagccatgaattgatgttgttaaaacggaggttataaatatttaaagtgtcacccaagtgtgttctaatagaaatgctgtgaccctgaggtcctgaggattgagagaggaagtgatgtcactgtgggaactgccctgtggagacaaggacatccctcatcctccgctcctgctcacagtgacactgatctggtaaagcccccatcctggtctgacactgtcatgggtaccagtctcctatgctgggtggtcctgggtttcctagggacaggtgagtcctcaaaacacaaagtagtttcatattttttctgtatgtaggtgtgtgtgtgtatgcatgtgtgtctgtgtgtgtgtgtgtgtgtgtgtgtgtgtgtgagatgactacaaatgttttccttattctgttgccagattctgtttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagcttagccacagcatggcacagtcgcctccttcctgttcacaaacctcatccttctctctctttgcagctcccagagatcattaacagaggcctctctttgctcctcacttttcctgggaaagaggtagatttggacctcggttgtcctttgggtggaaagagaccacagattcattcctgaaacacagtgactgcaaatgtaagtggtgaaaacaatcacgtcccactgcactctaggagggctcggagccagctcactgctccaaacaaggagtgggtgtcttagccttggccttcagagcagacatgcatcttctataggtcttggaggctgctgtgttgcccacatacatgaggttgtcataggcaggaaacatgcctcttcttcatatgttggggcatctggaaggtctgaggctacatccccgagaagatctttcttctgaagcctcttctatccctgtcaccttggaagttttctgccacaaaatatcaaacctctcttcctgtttgaagtaaaggtctttgcaaatttgtggtccttacttgataaatacaatcatggtaacaataacacttcatttcttctgcctactttaagccaagagtatcctttattttatttccatttgccattgctgctgtcctgatagacagaagcatgcatcaccaccgctgccacttcaccttgattcactcaggaaatctgattttcagactctgagtgttttgattgttgtccaactcatttgatttgaaataattctcccaaggcctttaactcaaaaagtgttttatttataatattgaatctattcctttttattatattttttcataatatatagtgttatatagcacttgttagaaatagaagtacaatgattatattgcaatagaatcttccatctgtctgtgggtgatgctgcagtttgtatctatgaaatggaatgcactggtcagagctgatgtgattatgcattatgggtttcggggagtcctcagcgacagaccacttctccaagtctgggactcagtgtcccagatgcaaccctgatagaggtgccctgaatctttcatagctaggaggggcatcatagtccttccaaattcactgatcagaaattatggtgtggtacagacaccaaatttctttccccagagaatgatggtcactggcagggaattgctcttgacccattttttcttgtgtcgtcatcaaatgactccttgctcagccgccctgtgtcttctgggactgagtaaggccagcacacagatgggaattccctgtcttctgagaccttctaactgctgccactttcctccatgtgactgctgagacaactggtcctaacagtggacaagctctgacactgaggctgaacagaccacagtccactgttgtaaatggtgctgcaagaacatgtaacaaaagtgagcagggcttccaatttatagagagaatgaacatgcaagaggagcaaagggtagatggtactaacgaacaaatagggaggaatgtggtttctgttctaatgaaatcattctgttgtcttaagttaagcaggagaaacatttcattgcaattacttcaagtcaaaggctagcggctccccaaccagccagcataactctttgctctgtgatctcagcagcttcagaggactcagaaatcctttctctgcacaaacatcccgttgtccattccaagacccaggatcacacactctgatcttatcatgaaaataatgaggtatgctatagttgctgtggcctcattttagtatgtttagtaggaagcattgaagaagtttgaagcttttctctttagtctatggcttgtatgactcaaaagaagtaaataggcatacttttcccagctccctgttcagtgaagccatgctgggagcttgaaatctgccatggtgggtatgttggtacacagaaattaggaaatgctaccagccatgcccccaccttcacagacacacagtttatcagcacattactggggtattttctgatgtccctcttatgccatttctgagctaggccaatatagctcagaatttatttccccactactcttgttcttagaacccatcacctaaggggccgtcaattgttcctatttccattcaactcccaaattctcttgcactgtagctctgtgtttccttcaagaatgccagtctggaacatgacaactattttgaatgtacctaaaggtatcactgaaccagttcattatttacaaattatctttcctcacatggaatattcagatgctggagtcattgggaacagagatggccaagcagcaactctgggttgtgaaccacatagagccccgctattcttctatgtcactgacagaccctgaaacaaggactattttgctttagaaactaagcagctccacaccagtcaggaatgactctgcttttactttaggctgagagatcagaaggatcacatcctcagtattctcctctcctggactgagtgtggccactctccatctcagtccctggaagttgtccagagttccctgagaatccctgctctggggcagaatcaccaaggctcatcctcaccagctccccacaggctccagcagggctttcctgccaggtgtagggcacaggaatggctctgtctgtctctcaggtagagggaggccaaacagtgatgtttgtataagagggactgggtttctgtgtctccattaaagtatttgacaatattttctttgttttttttttttttttggtttatttttccatctcgccaatgaggagagcaatcccttggtagttatattgtttttggcacttgggaaggtttttgtggttaagtcacattaagaaattgtgcctttttttcctgttcagctgtaacccaaggcagtgaaagaaacagcaataattttgaaagcagttacttgtgtatcttatgataaaggtgttaagtttcattgcccacatctaactttcagtctagtggaaatgaaaaggcacagttagggggcatgtgagcatgccatgagagaggtcaatgccaattgagaagtctgtgccaatccccagtactgtgggattgaaggggagggagagatgacctctccttcagaccatggtcaacaaggaaggagagggagttcatccatgggaacctgaaaagcagcaaatcccaggggcatctaacttcaggtgcaggagcaaatccttggagaggaaaatggtccagttcagctgtcacgggagacaggagaaagcaaagtcatctaatccacagtcccctggctgatttgcttccttatgatactattttgcatcagcgtgtcctcatctcccgctgctcctctgcctcttccagtgtcatctcttccctgtttgctgctcagatcagtggatgtgcattgtacaaggtgatcatttcctatagcagtccctttgctactcttagttatatccatccttattttctgcattaggtactgctccctccaccattgcttattgtcttgtaacaggtctcgttttatatatttcaattttactttttattaatagacatttgacttcatcttttgctgatctatacttttggggtaacattgtcatttttggaggatgtttttgtttatctttagtgattcagattaaataatctctttatacttcaacgtctgtgtcttcttactatttaaaaccaaatattatttcctttcattcctctcattctgttcctctttctttagatggtagttttaagggagaaaaagtttggctataactgaagctatgtgataagagttattcagaatgagggtgggatatcaagattggtaactcaaagcaataattagggttagaactaatgtaggacttagggtttagggaagctgctcataaaactgcgggatggcacctctggaatattctggcagctcactctgcagacacttcccagcattccttgggccattacagaattaaacaatgatgaagcttcacttattggccacaagatggcagtgtggtccactgcgaatgtaaagggctctgggcagtctgggggagcagcctaggagggaaaaggttaagaaaaattagggtttgtattcaatattatgcagatgttgcaggagttttcagttattgctaggctacctacagctatgcaagaggcaggaagtccctctaatctttaatcagatctacagttgaagaattttggccaggcagccttggtgtcggggcatgtgcagacagaggagcaactgcctcagaggaaaagggaaaagtgagaggcaggctgtgccctgagcccagtgggtctctgctgcacctcatcttccctgcaggtctggccaggcaacagctttaacctgcttgagtgatctgggattctccaagttcataagtcttactgataacatcaacttggctgaggttccattggaaatcaagcacatgttctctggaggacaaaaagtattgacaaaaatttctgaaacacctcagtaaacaaactattgaaggaaaatattagtagatgcaccaaactgtgccgttagagatgaagataatagactagtagaattttacaaaggagactataaataagtctctactaagtatttgtgggcatcaagcagtgtctgagtcctctcagggtagattaaggaaggaattcagctattatcatgactttggcttggatgaaaatccatgaagtcctcaattgattttcttgtaaaatattacagaataatattgagcaaacattttatttttctccagcctgtatccctctttagcactaacaggtaaagcagacacctagaggcacggtttctttagttgggatccattaactgtaggactgggaggtccatagctgggcttcacagggagttcaaaccccacgtgcagggaactccgtgtgtctgtgctgtgcccaactcccgtctgtgaggctgaaaagggggagtgccgggtctcccagtaccccactcacaaagtggggagcaggctgcttgctgggcaaaaaaatcaattcaaaaattggccaatctgttcaaagccaaaatgaaaggaaagtctgaattgtgagactgatgaatgcccaatttcccaagttatgaaatttgtagcagctcatggttctcagaatgatttcaatagcatatgaagatattgtaaaaagcttttgtttgtctacagctttccttgattttgatcctagttgtttttcggcccactcatcagttgagcttattttgatgccaaatttcaatgttgccacttcagtcaccaagcacttctcacattctccataacttacacagatatgtgtgttcctgtcttttcttatttttgtgtgattcatttttaaattgggctgtgcagaatacaagcatacatttgtaagtgaatcccatattttatgatttagctgtttactttttagtaatactttttattaaagtataatagagagtaaaacagaaatattaatacaaggacatcctggtacattttgacaaatgcatatgccagtgcaatagtaactgaaatgattataaaaaaaattctgtcatgcaggaaagtgtcgtcatgctcctttccaatcaatttctatcccagagataaaaattgtatttatttatttatttagagacaagagtctcactctgtcacccaggctggagtgcagtggtgtgatctcagctcactgcaagctctgcctccccggttcacgccactctcctgcctcagcctttggagtagatgggactatagatgcttgccaccacacccggctaattgtttgtatttttagcagagacggggtttcatcgtgttagtcaggatggtctcgatctcctgaccttgaaatctgcccgcctcagcctcccaaatttttgggattacaggcatgagccaccgcgcctggccaaaacttttcttatttttatcaccactgactagcttggtctattcttgaactccatataaatggaatcatataacattttattgagttattttcctccaaaattagtatttctgaagtttattcatattgttgtatcagtaggtcattttttcttatgactaatattccattgcataactataccacaacttgtttatccatgctcccgttgatggatatccacattactcctgtcttcaactattatgaatacagttgttgtgaacattcttgtggaactctttcttgtggacatatacattctttttttttattttattttaggtataaacttaagagtggaaatactgacttacagtgtagatgtgtgtgctatgcttgcgtgtcctcacaaaagctcatgttgaaatttgtcattgtaatggtattgggaggtgggacagctatgactaggtcatgagggatctgccctcagaaagagatcaatgccgttattgtgggagtgaattagttgtcttgggaatggtcttctgataaaaagtataaattcagccactttctctgtcttgggtgcttgcttccccttccttctgccttggataacagcaggaggccctcagccgctatggcccattgatcttggacttcccagtctccagatctataagccaaataaatgccttgtctttataaattacccagtctgtggtatttctctatagcagtaggaaataaatggaaagaaaacatggtgctgagagtgacgctgttgctgtaacaagtacctgaaaatgtagaaacagctttagttaatgggaaatggctaatggatagaggttggaagaattcagagaagcagactagcaaaagcctagattgctgaaaacagagcattaagggcatttctggtgaaagctcagggggaaatgaggaacaaggtatcagaaattgaagtaaatgccatccttctcataagtagcaaaaaccttggcaacattgtgtcctgttctaggactttatggaatataaaattatgagccattagctaggatatctgctgaaagaaatatctaagctgcaaagcattcaggccactgtgtgactacttttaggcaccaggcaatttaacccagcaagaaggcagccaagggaatagattttgcaaaccagcacagatggtgacactacctccctctgctgtcctgtctcccataagccaaactcactctgaagttagagaaaagaggagacagttaacatgatacactggagtcagcctgtgaaggcagggtggatctggagggattaacataaactttccagagcactacatataggatggccttgagggtgttgagtccaaagctggctaggtctgtggtgtgagctgataaggccctagatttatttctggggaatctgcactcttaataatttacagacaacacaggtctgctttggatctgatcagatggactaaatcttggggcctctgtaccgctggccactcaggaaatgggttgggaatgttgcctgggacaggaaaatatagtaagaaaccttggtgtgaatctagcttcagaaagatgatgtgaggagagcaaggaagagctggaaactgatggtttaatcacaggctcctcaccatctgctgataggcaggtgtgcgagctccagcatggagcaccgcagcactaggtcagaggagggtgatagggtgatggggcagcctgtgagctggggcagttaggcagaggagcaactgtatcaccacagaagcttctgccttcacccatccctccagctcggcaggacaggtagagagtccagtgtccgtggagcactagacctaaggaaggctgcatagggaagacacaagacagtgacatcacagcatacccctcccatcaggaaaatcaaggcccagaactcactcagctctttcccaggaggaccaagccctgaatcaggtgcagtgctgcctgccccactgtgccatgggccccgggctcctctgctgggtgctgctttgtcccctaggagaaggtgagtcccgggcacaggacagctgctccattctcagctttcccacccctgtgtcctccactttaccttggggaggacctccaggctgtctccagtgctcattatacatctgcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcagcttggcacagcccagcagagtcactgacattctgtatataaacttccgccttagctttgacttgagaactgcaggccccacccaggtttcactccttcaagggaagcttttagttgtttggaaggcatgtcttgtgtcctactgagggcagacctttcccaaccaatagagcccaggtttcctgtgccctgagtgtgcctgcttctgtgctgcaacttcttgtagtttgtcacttcctggataacttcagtagaagagtgactgttgagccccagatacgtgctagattcttcgtatttgttacatagcttaagggctttccacactcttgcacatcaaacatttctattcttcctttatagatagaaggctcagggacattgagtcattttccccagtgtctcttggcttgtaaggatcagaagtaggaaacaaactagtccatccattttccacctacccccctgctccatcatcaccttctgcatcctggtcagtaagtcagagccctcgcactgccctctagtgaccagcagggctgcagtagacgctcagatgccttcaggggtcattactatggcctcttcattagcaactttgaggaatgttaaatttaacactttttaaaaatcatttatatgcattccctttgtctttccccagtctgcagcttatgttttcacttttatggtgtttttttgatgcacaagagtttaatttaatgcaacaaaaactaaaatcaattttgtttgtgtgtagacaaaaaccgctttcttatataaatgtctaagcgtagttttatcaatttattctagtaaaatttaagcttggattttcaccactaagaataaatgtacctgaagtatatcttatgtaagaaataagatagagacctaggaatgggagggaaggacatatgttcagtgaagaagtaatagcctgtcaaagagagccctaaagtagacccccagagctgatggtggagaggtaagtggagggcaaatgatcatgaaccttgtccgtttgttaccttgtagaagaaaggcagccaggagtggagaccacatgggtgaaggtttatgacttgactgtaggttgaaggtggcagcaggtagagggaggactagcaggcagagggcagagtcactggctggcaggggcagtggcatcatcagttgactctactgacatccaggaattatgttcccaatgcgcaagttgaaaaactccccacaatttgcctattattccttgaccctgccatgaccaccagactcctcaatggtttggccgtctgccccctgagggcaggtgagtcccctaaagccttttccttggctcaccacatcccagcctaagcctttacctcaagtctacattattggggtccctctttgggcactcaacttccttctatcatagacttcacagaagctgggacaaccagatcccaagataccagagaacaaaggcaggacgtgaagtgacatggagatgcctgagactgccatccatgactacatgtgtaggtgttaataggagccaaggctggtgcacagctgatccgtcccagcacacactatacagaatccctgagggtctgtgactttttctcaaagccaaatatgtggccttggtgtcagacagcctctcccagacctctgtgcccccttgcaccagctttcaccccacagccaccttcctctgcacacaaagctcagtggtagatatagttggccttgtcttcatgagattttgatccaggcagtggaagacattgtcccataggagtttccccaacactgcccaggctgggactctcagatttctgagcagccctgtgcaagggaaactctgccctgtgctgagcttctctcccagggcagtctcagctggacaagggaatgcacatcacggtgatgtgagcagatgcagcctctcttccaggctcctcctccagctctggcctcagaagtcctcttcctcagttgctctcagaaaggaaagttgatttcaaaattgtatatttgcagacagcactgacaacacaggtctatgttcttttccctgtcagccttcacaactctatcttccccacaccatgctcatgtcagtcctcagcctcctccaagtgatgtctgctcctagctatcctctcatcactctgcaccctcacctccatgtcaaccacagacgcctgagttcaggccattcctcatgcatcatgctcctcccaccaaaggcctttgcactccacactgtattctctgtatcaacacgagtctcttctttttgttctttctccaaatctcagtttaactaccaccatctctagggagacactccttcaacagttttcctaggctgcacctccctattgtaaatgctcacagcttataatatgcattaatattcatagttttagcaccatagtcatttccctgactttgtgtggctatttcacacttctcttgcattctagactgtaaaatgcatcattgtagaaattgtggatgttttgttccccattttattgtcagtaccaacagcggttccaggtgccagtgaccagtcttgaaagaataaagaagagatattgaaaggccctctgagttcccacagactattccagaagtctggatgcattaaatgggaacctctatcccttcatctcctaggattaaatgagtcctggaaacagatgagaaatccctgtcatgcatgagtaactggatcccaagcctttctgcacgactgaacttcctcactgcccatcgccctcctggcttgtctcctccttcaatctccttccctcacaggtgtcctggatttgggagtctcacagacacagggcacctaatcactctgagagagtgatcagaaacataatgtcaaacactggcattaaaaggtgatggagaagaaaacaaatgccttccccattctcttaggcaaagttttcccaaggcacaaatatctttttgggtggctttgaggccatggtgcctgacacactgagctatattatgggtgttcatttccatgaattggtgggcaatgccagagacacagacctcatggtcaccagcttcctccagcccacacctgattttggtgcagggcgctgaacagagacctttgcttgttaccctcctttgccagttaggaaaggctgattgtgaggcagaggctccatttacagagcagggctatgtgttagtccctgaagaattgtgagagccattctgggtggaaataatcaaatatataatcaccaaggatggcccacggatagacagaagccccaattttgccagaatgatttgcatctatgctttaaagacaaatgcagttttatctctttaggcaataaagaccaaaaatagactagctattttaaataattgaaccttaaacagaccaaagtcagaacatcttccctagggacagcattttcttccacccactcactaaagctgtatttgagaaagctgtgtgctgttgataaacactgcaatatcgttacaatcgacatcataataatactgctacttggatcagaaacaaagagcatttctaaagcttgaacaatgtataactggaaacgagctctcactgagtttggaaatgcaggcactagagggtgctcatttctcttccttttccaatcagggggctattcaaaggctgttctagaacaaggggtgagatcctccacttccccgtggtgatcaggctttcagaggtagaagccttattagttcataatcagccgaactgacctcaccatcaaatgtatcgacctggatgctcaccctcctcagcagtcagagactgtgttcaccaggagcttgtgcgcttttacggagcacattttatcctcggtttattcggaaacatgggcctttatagggggttccataaacagaagctttctatattttgtccatttagacactacaaagtctgacaccagatgagaggtgttgcttaaagcttgtatgtggtgaagattttttaacaaataatatataaagaaaatgtcaataatgctctcaaatccaatcccaacttccatcggtaaccaatactaaagctctggtgtgctttgcacctctcttttctgtgttcatgcacacctttctacccaagtacatctacagaaaatgggttcacctgtacactttaccggccacatgcatactcttttctgttaatataccctggtctttattgttccagattgatcgatacacatctaacttgctctatttgctgcttcatattgcataatgagggtagacaggtacattcgtgctgtcatctgattcccaaattctgccagatcttttctaaagtgactgagtggtctatttatgcttccaagttctcctcaccccagcacccagttgatgattccagcttttccatcactcatggtcctagcaggtctgagagctctatcagttctcctgcatgaggaggcagggaaggataaaaggacagacctttatcaaacctaccagaaactacacagtatctcagttcatcctcataaagcattaaggggaatgtttgtcttgttttatagatgagtctagatgaggttagagtctaggaaagttaatgaatggccttgcccatggtctcagagctaataaatgttggaggcagatgaaggacagttttcttgcttctgtgtggagttgatagaggggtcactggattttgagggaggtgaagtccagaaccatctggggttgtcttcagatcagatgccagggtgcaggagagtctgtgtaccctacagcactgtaggtacaagcatcatggtgttggcagtggggaggtacagggggtaagtgtttagaggcctggaaccagaagatctgagctttgagaaaataatccccatcacaagatgtagcagagatactgatgtggatacactaggccagggagctctgtgaggagctgttgttaaaatgagggagggaggagaaccaactaattggtcacttcctatatgtgaaatgtagaggaaaacaatattaactagaatcctatctcattttagtcagttctcctttgtaagtagttggaaggtgggataatttattttcaaggttaagtaagcatctatacatctcctttaccttgtgaagtctggtggcgaagcgaaaaatggtacagccaatggagtcacagtttaataaataactcagagttcaaagggagactcttatgggccagaaattggtaaatgttcctgcattctaaaattaggaggatcttattttctttgaatcggcagagaaggaagcacaggcaatggggagggacagttgggaacacggcagagtggccacaggatgtcgaagacaaaggacatgtaatatcaaattctaagctgtgaagctgtgatgcaaccctccaccttctcctaatggattttttaggtctcagcacagatgcccacctgagggagtaatttctttggaaataaaggacaaatagctcggttaataacaagtccaccttacaaagcacacctggaaatggaaacaagattattcctaaggccttttctactctaagagtctctaacttggtggcaaggtgagaggtgaggatgggggtgttttgatccacacgtgatgagtaccatgaagctctaccatgaagcatatagtgttgagtgtgaatcagagccctaagaataactccctttacgttgttgtgccctctgccatcccaaacccaccccacccataattaagcagccacgaaaatgaggggagccagaaggaatcaaaccctgctgcttggttcagtagacagaaggacctggaggaagggtgttggctgggtctaggagaagatgatgagctcagaaaatagacaaggagaaaccccaggggaaaacttgtgaaaccccggaggaatcacaagatatgttatttgagctccttttaaattttatttaatactaaattaatggcaggaatcctgcacaaagggatattccctatgaaacatgacatctcagataaaaacagagcattcttccttaccctaaagtctgccctctctccccaagtccctcatgcatcaggtcacctttgtgcccataagtcatgggcagcgctgtgtggtcaacatcatccacacctagaggacagtcagcaaagtgaggtggttctgcctgctgtggtctcaccccaggcatggaaagcaagagccctgggagcagcggaaggtacacagctgggtttctcaggagtctcatctgtcagtgaattgacaagaaacagagcaaaacgactcctccaatgttgatgagcctgcccctgggatttggaaacttgataacagagaaaaccaatatagacaaaggattttaaacaggattatggtcaattaagcaaattagaaaaggatacttgaaggagtatttgggacacagaagtcaaaaacactaggaagacatgaggtgtgtccctaagactctagactacagcactgtgtagataactaacacttaactattaattatatcattgaagaaataaaatttacattgaattacaaactgtttccaaaaggtcatgaaaatcttgtagacttgtttcaaatcacacaaatgtgttcttctcattctcagctcttcactggtgcatttattttggatttgatcatctggggaagaggtgtggcctctcctgaaaggaggctctgggcccaggcagggagactgaggtctcagaatgactcccttgagagtcctgttcccctttcatcaatgcacagacccagaagacccctacgtcctgcagcccctgccatgagcatcgggctcctgtgctgtgtggccttttctctcctgtgggcaggtgggtcctggcagagccccttgcgtggatgtcaaggcccatcccctttccactggggctgcagcatcagctttgttcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagttattccacagcgctgcaagcctgtctcctctctgcacataaaggcacagaggctctgccctcctcccacccaagactcaaggatgccctgggcagagttctctgcaccaggaaccttggaacccagagtggccccaagtggccaggacagtatgagtctcactctatgccaggtgccacttcaggcagtctcagccaggcctggaagtggtcctaggttctcagatgtctcctttgttgctctctctggtatatcctccaagctgtcctttttgtgtagggccagggcttccccagctcctactttcctactcattatcctgaatccaaggtgcccaggatgaaactggatttgtatgtcagattcatctatactcccatctctccctggtgaccctgttgcttcctctctctatggtttcccccagcccccatcctcacgtgatctctcctgtggcccacctttcccatctgggtagtcaccctccaagtccttgctgggtctctcctcccctcacctccccgcccctttctactgcagccattaggggagcccctgttctgtgcctccttacttcccatcacagagacttcaaagtccatttcctctgccctgggctggagccttccttcctctaatggccagctcctacctgtgcttcagatctcagcatgatccgcccctcctgcgggaagcacaccctcacctccctgctgagatcaactttcctctcataagctctcacagaatcatatgtctgttggtaacctttagcacagttggactttctcaggtacttatctgattatttttgtgctccacccaatttttttttttttttttagacagagtcttgctctgtcaccaagctggaatgcagtggcaccatctcggttcactgcaacctctgactctttggttcaagcaattctcctacctcagactcccgagcagctgggattacaggcacacaccaccacacccagctaattcttgtttgtatttttagtagagatggggtttcaccacgttggccaggctggtctcgatctcctgacctcatgatctgcctgcctcgggctcccaaagtgctgggattacaggcttgacccaccgcgcccggcctctccacccaatttttaagcccatgggagctaagagtgtgccggctgcatttaccaatattggtgcctggcatgtggggagacccatttcacagagaatggatgagtgaatgagaggctgagtgagtgatgagtgggtggacgaacaaatagtaggaacaagctacatctactgtaaactggcagagatctagcattaagtacaagaaagcccacccctttgactgctgggctcaggtcggtcttggaaattgatggggaatcactatcatggcatccacacctgtgtcaaggcttcctcttgtggctgcagcacctgacctcctccaggtctctgtgctctccttcaggatctttccccacaacaaatctagacagatcagagatccgcttcaagaattccatccttaaaggttgttccttgaaaccacttctggtaagaaaatctccattaggtttgcatcaataaaacagggccactacaagtttgagagtgtaacagatttatgatcagaattagactttatgcatatgtgggaggagctgaggaagacaaggtcttgaggagagaagtcagaaggtgagggagccagtcagtagtcagggctcctgaagctctgggcaggacgtgctggagtggcaggaacatgagaggatcagagcatatcaggccatgcagtgggatcttgagctgggagcacaggaaaatgccaaggaaatctgtttctgggaaagctgttccctctctatgggggccacccctgcagatgcactaccaaacactgtgggcagcctggctgctgttggccagcatttgggaagatgaactggacacagggtgcagaaggaacaggacttcctaggtctgttggatgcctctatatctgctggtcactgactctcactgtccaaccacgataacctgccaattgtcatagtgactgttttatatctgtcttctaaatgttacaaaatgtatccttgaccatctgtaacccagaatgataaaagaaatggcattctggtaaatacaggctcttgccattgtagagttgacctaacacaatccagcacaggatggattctcccagattaaggcattggacctaacacaatccagcacaggatggattctcccagattaaggcattggatcacacaactgccccaacccgccacaatccctggtcttctatccgggggacacctgtgctgcccaggtgaatgtggacacaatttgtgtgtagatgttccagacgctggtgactaacttttcttttaatcctgtgcctgaagtctccctccacccagagagtctatatgtgtatatctgtctgtctatctatctctatctctatctctctctctctgtaatttccacttggaagaaaatgtcatgatgactacatgttactgggatttatttatgaaaaggattttattaaaaagaattagaaaatttgaatccttttctgaatttttccttgggactgtcctgagagcatttttgacatgaccaacctttgtcgtgtgtgtatttggcagcctagagtgcagcagagagttattggccccacatatttgcgagttagactggagatggctgtaaaaatgactgactcttagtgttattcactctcagtctgggcctcactagaatgtcacagactaccatcgaacaaatagattcccagtatgaagaatattaggacatagcaacgaggaaacatgagcacaagcaacaaacgtttgaagtgcaaacctgaagactcgaaattttggcattataagatatgaaagtttggagagctacatttaaatgaacatgagggggaactgaaacaaggaaaaagagaatgtctgaaaccaacaacttgcataaaaattgtcaaatagtatatctaggaatgcctcatacaatcactgaaaacaaaatggaaaggcaagcagttgataagctcctcctatagagatttttagtgatgtcaaagatggatctgcaggagtgatctagaatgcagcacagaaaataaaaagtgaaatatgaaagaagttaaagaacaaggaagaaaaaaatggatgtttcctatgtattagaatatgcatatttttcataatttctcattcttttcttgcatatgatttatgtttcaaaaagataaataggaagaatgttatgaggtgatatttatgagatgttagctgagaatttttagacgtgtttcaggacctaagttcagagtttccagaatcaaaatgaatctcaaataagacagtcaagtcatagggaaattgtagaacatgagggaaaaagagaagattttgaaagcagtcagaaaggaaagagaaatacgtcccatagaatagatggagaacaacagtaagtcaagatagtagttaaaaataaccattagctcaattatcattctccttcatttaaggtgagattgattaaaaaaacttttagaagtggaatatgaaaaatgactgctgtgagtttgctaccaaggtctctttactgaattacagttaagaaaggtgggaaatgatcccagaagaaaggcatgagggcagttcgtgagggaacccatgtgatgggacagtcccattggacacgtgtgactgtgggaatggaggaggctggggcatcagtgaggatggcagaggggaccctgaattgcaggatagacaatgagctcatgccttggtgccttgtgttgggggtgctgttagtgcatcgacaggacatgcccagcagacagaggagtggctgtaggatgagaaggtgaactcagagatgtagtgtgaggcccacgggtccagacagcatgggagcccaaaaaatgaaccatgcattgatagtggtaaaaagctgatacatatttaaagcagcacccaagtgtgttctaatagaaatgctgtgaccctgaggtcctggggattgagagaggaagtgatgtcactgtgggaactgccctgtggagacaaggacggcccttatcctctgcttctgttcacagtgacactgatctggtaaagcccccatcctggcctgaccctgccatgggcaccaggctcctctgctgggtggtcctgggtttcctagggacaggtgagtcctcagaacaccaagtagtttcattttttctgtttgtaggtgtgtgtgtgtgagagagtggttgtgtgtgtgtgtgtgtatgatgactacaaatattttccttattctgttgccaaattctatttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagcttagccacagcatggcacagttgcctccttcctgttcacaaacctcatccttctctctccttgcagctcctagagaccctaaacagaggcctctctttgctcctcacttttcatgggaaagaattacatctggacttcagctgttctttgggtagaaagagaccacagattcattcctgaaacacagtgactgaaaatgtaggtggtgaaaacaatcatgggagtccttggagccagctcactgctccaagcaaggagtgggtgtcttagtcttggccttcagggcagacatgcatcttctataggtcttggaggctgctgtgctgcccacatccatgaggttgtcatgggcaggaaacacgctcttctcctgcatatgttggggcatctggaaggtctgaggttacatcccaaggaacatctttcttctgaagcctcttctatccgtgtcacattagaggttttctgcaacaaaatatcgaacctctcttcctgtttgaagtaaaggtctttgcaacttttgaaatccttacttgataaatacagtcaggataacaataagacttcatttcttctgcctactttaagccaggtgtatccttcattttatttccatttgctattgctgctgtcctgatagacagaagtatgcattcaccaccactgccagttcaccttgattctctcaggaaatctgatttctagactctgagggttttcattgctgtccaactcatttgatttgaaataatttttctgaggccgttaagaagtgttatatttataatattgattctattgctgtttatttttcatattatatattgttatatagtacttgttatagatagaagtacaatgattatattgcaatagaatcttccacctgtctgtgggtgccgctgcagtttgtatctatgaaagcgaatgcactggtcagagctgatgtgattatgaatcatgggtttctgagagtcctcggcgacagaccacttctcccagtctgggactcagtgtcccagacacagccatgatagaggtgccctgagtctttcctaggtaggaggggcatcatagcccttcccaattcactgatcagaaattgtggttgtacagataccaagtttctttcctcagagaatgacggtctctggcaggcagttgctctggacccattttttattgtgccatcatgaaatccctccttgctcaggtgccctgtgtctcctgggactgagtaaggccagggcacagatgggaattccctgtcttcctagaccttctctctaatggctgccaccttcctccacttgactcctgagacatctggttctaacagtggataagctctgacactgaggctgaacagaacacagtccacaggtgtaaatggtgctgcaaggacatgtaataaagtgagcagggcttccaatttatactgagaatgaacatgcaacaggagcaaagggcagacattactaatgaacaaatagggtttctgctctaatgaaatcattctgttgtcttaagttaagcaggagaaacttttcattgcaattacttcaagtcaaaggctagcagctcccaaccaaccaggataactctttgctctgtgatctcagcagcttcagaggactcagaaatcctttctctgcacaaacttccctttgtccattccaaaacccaggatcacacactgatcctatcatgaaaacaatgaggtgtgctatagttgctgtggcctcatttttagggtgttcagtaggaagcattgaagaactttgaaagctttgctcttgagtctagggatgtgctggagccagcttgtatcattcagaagagccaaataggcatactcttcccagctccctatttagtgaagccatgttggcggcatgaaatctaccatggtgggtatgctggtacaaccgaaattagcaaatgctaccagccatgcccccaccttcacagacacccagtttatcagcacatccctggagtattttctgatgtccgttatgccatgtcttgtgggcccaaaagggctcagaattcacctcccctctagtcttgctcctagaagccatcatctaagggggcctccattgttcctatttctgttctacctccaaattctcttgccttgtggttgtctcctacaagcatgccactttggaacatgacaattattttgattgtgactaaaggtatcactgaaccagttaattttttatgaattatctttcctagcatggaatattcagatgctggagtcattgggaacagagatgagcatgcagcaacatgcaagttgtgaaacacttacagccccgctattcttctgtggcactgacagaccctgaaacaaggactattttgctttggagactaagcagctccgcaccagtcaggaatgactctgcttttactttaggctgagaggtcagaaggatcacaccctcagtattctcctctccaaggcggagtgtggccactctccatctcagtccctggaagttgcccagggctccctgagaatccctgctctggggcagaatcaccaaggctcatcctcgccagctccccacaggctccagcagggctttcctgccaggtgcagggcacaggaatggctctgcctgtctcttaggtagagggaggccatacaatgatgtttgtataagagggactgggattctgggtctcctttaaagtatttgacaggccaggcagggtggctcacgcctgtaatctcagcactttgggaggccgaggtgggtggatcatgaggtcaggagatcgagaccatcctggctaacatggtgaaaccccgtctctactaaaaatacaaaaaattagccgggcgaggtggtgggcgcctgtagtcccagctactcgagaggctgaggcagcagaatggcatgaaccccagggggcagagcctgcagtgagctgagatcgcgccactgcactccagcctgggcaacggcgagactccatcttaaaaaaaaaaaatttgacaaaattttctttgatttttgttctattttgccatctcaccaatgaggagagcaatctcttggtagttatattgtttttggctcttgggaaagtttttgtggttaagtcacattaagaaattgtgccttttttccctgttcagatataacccaaggcagtgaaagaaacagcaataattttgaaaacagttagttatgcatcctatgataaaggtgttaagtttcattgcccacatctaactttcagtctagtggaaatgaaaaggcacagttagggggcatgtgagcatgccatgagagaggtcaatgccaattgagaagtctgtgccaatccccagtactgtgggattgaatgggagggagagatgacctctccttcagactgttctgaacaaggagggagtgagagttcatccatgggaacctgaggaggagcaaatcccaggggcatctaactcagggtgcaggagcaaatccttggagaggaaaatggtccagttcagctgtcacaggagataggagaacgcaaagtcatgtaatccacagtcccctggctgatttgcttccttatgatcctattttgcatccgtgtttcctcaactcccgctgccccctgcctcttccagaatcatgttttggctctttggtgctcagatcagtggatgtgcattgtacaagttgatcatttcctgtacaagcccattgctgctcttaattatatccatccttattttgtgcattaggtactgctccctacaccactgcttattgccgtgtaataagtctcattttgtgtatttcagttttactttttattattacacatttgacttcatcttctgcttatctatacttttggggtaacattgttatttttggaggacatttttgtttatctttagtgattcagattaaataatctctttatacttcaacgtctgtcttttatttctatttaaaaccaaatattattttcttttattcctctcattctgttcctctttctttagttgatagttttaagggagaaaaatttagactataactggagctacgtgataagagttattcagaatgaggctgggatattaacattgttaactcaaagcaacagtcagcattagaactagtgttgggatgagggtttagggaagctgctcataaaacctgcagaatggtacttctggaatattctctcagctcactctgcagacacttcccagcattccttgggccattgcagaagcaacaatgatgaaacatcacttactggccataagatggcactgtggtccactgggatctaaagggctctggggagtctgggagagcagcctaggagggaaagggttaagaaaaattagggcttagatccagtattatgcagatgttgcagcagttttcagttttgccagactacctacagctatgcgagaggtgggaagtccctctaaactttaatgagatctacagttgaataattttggctggacagctttggtgtcagggacaggtgcagaggagcaactgcctcagagaaagctaggggcaggatgtgccctgagcccagtgcatctgcgctgcacctcatcttccctgcaggtcttgccaggcaacagctttaacctgctcaagtgatctgggattctataagtttgtaagtcgtactgataacatcatcttggctgagattccattgggcaccaagcacgtgtactctggaggacaaaaaatattgataacagttctaaaacactcaagtaaacaaactactgaaggaaaatgttaatagatgcaccaaactgtactgttagacttgaaaataatcaactaatagaattatcaaaaagagactacaaataaatctttactaagtatttgtgggcatcgagcagtgtctgagtcctctcagggtagattaaggaaggagttcagctattatcatgactttggcttggatgaaaatccatgacctcctcaactgattttcttgtaaaatgttacagaataatattgagcaaacattttatttttctccagcctgtatccctccttagcactaacaggtaaagcggacacctagaggcacggtttctttagttgggatccattaactgcaggactcggaggtccatagctgggcttcacagggagtgcaaaccccacgtgcaaggaaccccgtgtgtctgtgctgtgcccaactcccttctgtgaggctgccaaaggcggaggtccgggtgtcccaggaccccactcacaaagaggggagcaggctgcttgctgggcaaaaaaatcagttcaccaattggccaatatgttgaaaaccaaaaagaaaggaaaggctcaattgtgagactgacgaacacccaatttcccaagttatgaaatttgtagcagctcatggttctcagaatggtttcaacagcctatgaagatatttttagaaagtttttgtttgtctacagctttccttgatattgatcctcaggtttttttcagcccactcatcacttgaccttattttgtggccaaatttcagtgttgcctatttcagtcactgagcacttctcattctccaaatcttacacagatatgtgtgttcctgtcttttcttctttttgtgtgattcatttttaaattgggctgtgcagaatacaagcatacatttgtaaatgactcccatcttttatgcaatttagctgtttaatttttagtaatactttttatttaaggtgtaattaatacacagtaaaacacaaatattaatacaaggacatcctggtacattttgacaattgcatgcgccagtgcaatagtaactaaatgattattaaaaaactttccatcactcaagaaagtgtccttatgctcctttccaatcaatttctatcccagagataaaaacttttctatttttatcaccactgactagctttgtctattcttcagtttcatataaatggaaacatatttttattatttttcttcaaaattagtagttttgaagtgtattcatattgttgtatcagtaggtcattctttcttatgactaatattccattgcataaatataccacaacttgtttatccaagctcctgttgatggatatccacgttatgtctgtcttcaactattatgaataaagttgttgtgaacattcttgtggaattctttcttgcgaacatatgcattcttctttttttttttgatatagatttaagagtggaaatactcatagtgtagacacgtgtgctatgcttgcgtgtccccacaaaagctcatgttgaaatttgtcagtgtaatggtattgggaggtgggacagttatgactaggtcatgagggatctgccctcagaaagagatcaatgcccttattggaggggtgaattatgtcttgggaacggtcttctgataaaaaggatgaaatcagctgttttctctgtcttgggtgcttgcttccccttccttctgccttggataacagcaggaggccctcatcagttatggacccttgatcttggacttcccagtctccagatctgtaagccaaataaacctcttgtctttataaattgcccagtctgtgatatttctctatgtcagcaggaaagacattgaaagaaaaaatggtaccaagagtgaggctgttgctataatacctgcaaatgtagaagcagctttggttaatgggaagcggctaatggatagaggttgaaagaactgggaggagcagactagcaaaagcctagactcctgaaaacagagcattaagggcaattctggtgaaggctcagggggaaatgaggaacaaggtatcggaaattgaagtaaatgccatccttgtggtaagtagcaaaatccttggcaaaactgtgttctgttctaggaatttattgaatataaaaattatgagtcattcgctaggatatctgctgaaagaaatatctaagtggctaagcattcaggctaacgtgtgactactttcaggcaccaggaaatttaaccaagcaagaagggagccaagggaatagattttgcaaaccagcacagatggtgaccctacctccctctgctgtcccatctccaataagacaaattctgtgctgttagctgttaaagccctagaattatttctgaggaatctgtactcttcataatttacagacaacccagctctgctttggatctgatcagatggactaaatcttggggactctgcaccactggccactgaggaaagggaagagaatgttgcctgggacagaaaatatagtaagaaacattggtgtgaatctagcatcagaaagatgatgtgaggacagcaaggaagagcaggaacctgaagtttaatcaggctcctcgccctctgctgatgggcatgtgtgtgagctccagcatggagcaccgcagcactaggtcagaggagagtaagagggcgatggggcagcctgtgagctggggcagtgtaggcagaggagtaactgtatcatcacagaagcttctgccttcaaccatccctccagctctgcaggacaggtagagagtccagggtctgtggggcactagacctaaggaaggcttcctggggaggacacaggacagcgacatcacaggatacccctcccatcaggaaaatgaaggcccagaactcactcggctcttccccaggaagaccaagccctgaatcaggtgcagtgccgcctggcccactgtgccatgggacccaggctcctcttctgggcactgctttgtctcctcggaacaggtgagtcctgggcacaggacagcagccccattctcagctttcccaccccagtgtcctccactttaccttggggaggacctctgggctgtctcctgagctcatcctccatctgcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcagcttggcacagcccagcagaatcactgacattctgtatataaacttcctgccttagctttgacttgagagctgcaggccccactcagtcttcactccttcaagggaagcttttagttgtttggaaggcatgtcttgtgtcctactgagggcacagctctcccaaccaacagagcccaggtttcctgtgccctgagtgtgcccacttctccgctgcatcttcttgcagcttgtcacttcctgggtaacttcagtagaagagtgactgctgagccccagatgtgtgctagattctttgtatttgttatgggcttaaagccttgcaacaatcttgtacatcaagcattcttattcttccttgacagatgggatgctcagggacattgagtcattttccccgttgtctcctggcttgtaaggatcagaagtaggaaacaaagtagtccatccattttccacctacccccctgctccatcatcaccttctgcatcctggtcagagtaagtcagaaccctcacactgccctctagtgaccagcagggccgcagcagaggctcagatgccttcaggggtcattactatggcctcctcattagcaactttgaggaatgttaaatttcacactttctaaaaatcatttatatgcattccctgtgtctttccccagtctgcagcttatattttcatttaatggtgttttttgatgcacaagagtttaatttaatgcaacaaaaactaaaaacaattttgtttgtgtgtagacaaaaaccgctttcccatataagtgtctaaatatatttttctcaatttattctaggaaaatttaagtttggattttcatcactaagaataaatgtatctgaaatatatctcatgtaaaaaataaggtggaaacctaggaatgggagcgaaggacatatgttcagtgaagatgaaatagtgtgtcaaaaagagctggaaagtagacacccggagctgatggtggagaggtaggtggagggcaaataatcatgaaccttgtcagtttgttatcttgtataagaaagacagccaggagtagagaccacatgggcaaaggtttatggctggtctgtaggttgaaggttgcagcaggtagagggaggaatagcaggcagagggcagagtcactgtagggcaggggcagtggcatcatcagttgactttactgacatccaggaattatgtccctaacacacaagctgaaaaacctcccacaatttgcctatttttccctgaccctgccatggccaccagactcctcagtggtgtggccttttgcctcctgggggcaggtgagtgccttaaagccttttccttggctcaccacatcccagcctaagcctttacctcaggtctacattattggggtccctccttgggcactcaacttccttctatcatagatttcacagaagctgggacaaccagatcccaagataccagagaacaaaggcaggacgtgaagtgacatggagatgcctgagactgccatccatgactacatgtgtaggtgttaataggagccaaggctggtgcacagctgatccgtcccagcacacactatacagaatccctgagggtctgtgactttttctcaaagccaaatatgtggccttggtgtcagacagcctctcccagacctctgtgcccccttgcaccagctttcaccccacagccaccttcctctgcacacaaagctcagtggaaaatatagatggccttgtcttcacgagaccgtgatccaggcagtggaaaacattgtcccataggagtctcccaacactgcccaggctggggccctcagatttctgagcagccctgtgcatgggaaactctgccctgtgctgagcttctcttccaggccagtctcagctggacgatggaacgcacataaccatgctttgcgtggatgcagcctctcttccaggcccctcctgcagctctgacctcagaagtcctcttcctcagctgctctcagaaaggaaagttcatttgaaattgtatatttgcagacagcattgacaatacaggtctatgttcttttccctgtcagccttcacaagtccatcttccccacaccacactcacgtcagtcctcagcctcttccacgtgatgtctgctcccagctgtcttctcccttcctctgcaccctcaccttcatgtcaatcacagatgcctcaattcaggcccttcctcatgggtcatgctcctcccaccaaagccctttccactccatgctgtatcctctggctcatcagaagtctcttctcttttgttctttctccaaatctcagtttaactaccaccatctctagggagacactccttcaacagttttcctaggctgctcctccctattgtaaatgctcacagtttataatatgcattaatattcatagacttagcaccatagtcatttccctgactttgtgtgactgtttgacacttctcttgcattctccactgtaaaaggcatcattctagaagttgtggatgttttgttccccattttattgtcagtaccaacagcggttccaggtgccactgaccaatcttgaaagaataaagaacagatattgaaaggccctctgagttcccacatagactgttccagaagtctggacacattaaatgggaacttctatcccttcatatcctaggatcaaatgagtcctggaaacagaggagaaatccctgtcatggatgagtaactggatccaagcctttctgcactactgaacttcctatctgcccatcgccttcctgcctagtctcctccttcaatctccttccctcacaggtgtcctggatttgggagtctcacagacacagcgcacctaatcactctgagagagtgatcagaaacataatgtcaaacactggcattaaaaggtcatggagaagaaaacaaatgccttccccattctcttaggcagagtgttcccaaggcacaaatatctctttgggtggctttgaggccatgctacctgacacactgagctatattatgggtgttcatttccatgaattggtgggcaatgctagagacacagacctgatggtcaccagcttcctccagcccacacctgattttggtgcagggcactgaacagagacctttgcttattcccctcctttgccagttaggaaaggctgattgtgaggcagaggctccacttacagagcagggctatgtgttagtccctgaagaattgtgagagccattctgggtggaaataatcaaatatacaatcaccaaggatggcccacggacagactgaagccccaattttgctggaatgatttgcatctatgctttaaatacgaatgaagttttatctctttaggcaataaagaccaaaaatagactagctattttaaataactgaaccttaaacaaaccaaagtcagaacatcttccctagggacagcattttcttctacccactcactaaagctgtatttgagaaagctgtgtgctgttgataaacactggaatatcattacaattgacatcgtaataatactgctacttggatcagaaacaaagagcatttctaaagcttgaacaatgtaaaactggaaacgagctctcactgagtttggaaatgcaggcactagagggtgctcatttctcttccttttccaatcggaggctattcaaaggctgttctagaacaaggggtgagatcctccacttctccgtggtgatcaggctttcagaggtagaagccttattggttcataatcagctgaactgacctcaccatcaaatgtatcgaccttgatgctcaccctcctcagcagtcagagactgtgttcaccaggagcttatacgcttttacatagtacactttatcctcggtttattccaaaaaatgggcatctataaggggttccataaacagaagctttctgtactttgcccatttagacactataaagtcagacaccagctgaaaggtgtaacttaaaagcttgtatgtggtgaagattttttaacaaataatatataatgaaaatgtcaataacgctctcaaatccaatcccaccttccactggtcaccaatattaacactctggtgtgcttcttttcacctctcttttctgtgttcatgcacacctttctacccaagtacacctacagaaaatgggttcacctgtacactttacctgtcacatgcatactcttttctgttaatataccctggtcttattgttccagattggtcaatatagatctaacttgctcctattagctgcttcatattgcataatgagggtagacaggtacaattgtgctctattgtctaattcctgaattctgccagatcttttctaaagagactgaatggcctctttaggcttccaggttgtcctcaccccagcccccagttgatgattccagcatttccatcactcatagtcctggcaggtttgagagctccattggtttctcctgcatgaggagacagggagggataaaaggatagacctttatcaatcctaccagacactacacagtatctcagttcgtcctcctaaagcattgaggggaatgttagtcttgttttatagatgagtctagatgcagctagagtccaggaaggttaatgaatggccttgcccatggtctcagagctaataaatgttggaggcagatgaagggcagtcagcttgcttccatgtggaattgatagaggggtcactggagtttgacagaggggaagtctagaaccatctggggttgttttcagatcagacaccacgggtagtatggtctgtgtaccctacagcactgtagatacaagcatcatggtgttggcaatggggaggtactagagaggtaagtggctactggcctggaaccagaagatcatagctttgaaaaaaattattcccagcacaagatgtagcagagacatcaatgtggataaactaggccagggagctctgtgaagagctgttgttaaaatgagggagggagaagcaactaagtggtcacttcctatacattaaatgtagaggaaaacaatgttaactagaatcccatctgattttagtcagtttttcgtttaagtagttggaaggtgggataatttattttcaagtttaagtaagcatctatacatctcctttaccttgtgaagactggtggcgaagggaagaatggcaaggccaatggagtcacagtttaataaataactcagagttcaaatggagactctcatgggccagaaattggtaaatgttcctgcattctaaaattaggggaatcttattttctttgaatcagcagagacggaagcacaggcagtggggagggacagttgggaatacagcagagtggccacagaatgtcgaagaaaaaggacatgtaatgccaaattctaagctgtgaagctgtgatgcaaccctcctccttctcctaatggtttttttaggtctcagatgcgcacctgagggagtaatttctttggaaatgaagaacaaatagctgtgttaaatcttaataacaagtccaccttacaaagcacaactggaaatggaaacaagattatttctaaggccttttctactctaagagtctttaacttggtggcaaggtgagaggtggggggtggggatggtgttgatccacatgcgatgagtaccgtgaggctctaccatgaagaatacatttctgagtgtgaatcagagccctaagaataatgccctttacgttgtttgggaccaaacccacctcacccataattaagcagccatggaaatgaggagagccagaaggaatcaaaccctgctgcttggttcagtcgacagaaggacctggtggaaggatgttggctgggtctaagagaagatgatgagctcagaaaacagacaaagagaaatcccaggcgaaagcttctgaaaccctggaggaatcacaagtcaaatttctcccagaagatggtggcagtgactcaccttcaggtacaactggctggtgctacagagctaagatggacttagtgtgttggcagtttgcaaaatctgggccatttggtcattttcttcagtgactttttaaagtgaagttttacttccaacattggcctgatgtgtgggtctgttcttatgggggttagggttagagttgctccattacttgagtacccatgaagtattattggtcatagaatgagcaggattatcaggagtagaaggggtagggagagggagaactgttaagtgaagcagtagggttgagtgaagagtattttagacatatgagtacatagagggatgaaagcccagctagcccccagcccccatagaaggaagatcaagatttgacaactaggagaggcatgattacaccatgcagcttgatcaaggactgagaaagctttctagacaaatgacaggtaatgacccacactgtgaatcggtattgaacgtgagatgtcaatatatattcatatatccacttatatatctaaaataagaagtccttacaaaccctgaaaacataaaccctcactattacaggatgtgcaggtgatttggatcctgtgaagaccctcaaacaggattaaaatccagtaggcagaggtctctgattctttgttagctacagaggaagatgtgctatgatggacacctagggggtctgggggtcttcccatccccttcccagatccacacctagaggaatgtcaggcagcacaattcagagaaccaccagaaaagctgtgagaataggactccaatctgaatccagcttctctcagctctgcaccccttgctgtgtaggagtcagtgcaggagaaagctgactgggtgagaagagaagggatcctgaaccatgccagaggagacctgtgaactgggaaatgagcagcaacagcaccaccacagacacacactcgccaggcacagggagaggacagatcctggcctcttgtagcaccagagctctgaacgccctctacctgctcagtctcccatgggatctaggctcttctcctgggcgctggacatgccttggtttctcaaaaccaggtgtgtcctggatgcacctgggggaatctcagctctgaatatgccaagccttgccagaggaaccatgtattttgaaaacccacggggtctgtgttaaaaacaacaatttccctctcagagcatgatgggattccatgttcctgcttagttgtgctttgtctcctgggagcagatggctctggaaacctctgagggaaatccctgtccctgcaactgctgtgcctcagttccaaacattccccatgcagtctcctacgtcctagctccaggttctatctccattcatgaaactgtgctcacacagacctcttgaaagcaggtaatgggtatggagcagcaataggtgtgaatacatcctactttatggcatcatctatgggaagcaatgtcagctggaaatgcaccagcatgaattttatactattgtgatgtagcacttctgagattgaaggtacaatggcatattccaagctggtcaaccaaacatctcactccatcagctggacacacatcccctagtggggtgggattctgtgggtctccttttgccagcagcaaagaccttgctgaaccatctcctctgctttgcttcaaacttttcctccactttgcaggatcttctcaaatctgggtctaacttgcctgcagtgagaggaattgtgactattgtccctcatatgaaagagggtgcccatgaagttttaagagttaagttaggaatgaaaatgagaaattaattgctcataatgcagactgttaggaaccccaaggattaattcaactccctattttttaattgtactactcccatcacaatgtcaagggtaaaacagttctgactttttctaaaggctatggaacatttattgatttcagaggtgacttagaaacacaggaggtgtcgtgataagtagtagagacaaaaaagaaaaagtattgagattaatgaattcatatggggaattgtttaactgttctttttttaacctttagaatgagttgaagatcccaacttagcttggtgcctgctggaggcaacgtttcttcccttgcccctctgagctgtgaattgaaactctttcgggaaaaagacgcggcaattctctccacttcccaaacacctcccactcctacccagaccgtggatgggcaggaaatgcaggaacagagccagaaacaggagatctccaaggaaggttgacagtcagcactgggatcgtctgtgtaaagtgctgctgaagcagccaggtggcatgtccagccgacaatgcgaaaggaaaaagtgagaagacttcccgaaggcggagggtggaatgcgggcagcagccccctggagggctgagtggggaaaacaaaatggacctcacagaagctgtgtgtgtggaaacccacttctgacttatcacttgtcatgaattctatgcttcatggtgttacaccgtttattgtttctgatgagtgacagtaattattttctttcttgctggtacataataaagtggtgcacatcagagttgctgccatcttagacttaactcatcagtatcaggtgatcctgaggctcagtgatgtcactgtgggaactgctctgtggcgacaaggacgtccctcatcctctgctcctgctcacagtgaccctgatctggtaaagctcccatcctgccctgaccctgccatgggcaccagcctcctctgctggatggccctgtgtctcctgggggcaggtgagtcctcagaacaccaagcaatctcattgtgtctgtgtatgtctgtgtgtgtgtgcgtgtgtgtgtgtgtgtgtgtgatgactacaattgttttcctcctgttcccaacttgtatctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcttagccacagcatggcacagtcgcctccttcctgctcacaaaccctcaggcacttacttctccttccagctctcagaagccctgaacaaaggagctgccctgctctttcctcagcaaggagaatgaatgcatttggaactgcaggtgttcttctgatactaggaggtcagaaaataacctctgaaatacaggaacagggaatactgggtagtaataattttgacttatggatttctgggattccttatatatagttcaaatttccataattaggatataacagagcttagtctcatggatagtgactaagtaaatattcttttatagaactatgaagtttcagcacatttatattaaactactgttaccacatgtcaccaactcagacctataatctaccaaggagtggggaagccaaacgcaaacactgctaaggccatttacagctaccacccttggaagaaaattggaatctttagtaagaatttccatcaaaatcaattttttagaaataactattacccacaataatgcacattaactcatgttcatacattgctttttttccttctgaaaatcttgtagtcattctatgtttaatttccttcttctccagtctaacttaaaaaaatagaaatacaaattgagattgtttcataagataaaccccacctgggaaggtgttaaaaggacacaattcaaagaaaacctgaataaaattatatcaaccacgtaggattctttgaggtttccaaagaagatgtaccagtttacattcccacgagaggtatatgagttttggatggaatttttttttttctctctctctctctgtagattagtttttccctctactaatagtttctcttgacaaacagaagttcttaagtgacaatcattccatgtttctcccatttcagttagtgttttgtattttggtgtccactttaggaaatccttgcttacttcaaaatgatcatgttttcttacatttccttctaaaatctttatattttccacttttcatacttagactcacaatcgaactggaattaattctttgtaggtgatatgaggaagaggtcaagttctatttttccaaatgattattcaatttacccaatactatttaagtggtaatagtttcaccatcactcgataatatcacttttgtcataaatccgtcattatacatgtgtggccttttttctcggatctctattctgttacattggtctgttctgtcagttctcgcactgataatatgctgtcttactacagcttcatccttattcttaatatctggtagaataatttctcaagcttcgctcctttttatcaagtgttcttgagcactcttgacactttttttccatatacattttagaatcagcttgctaaattattcaggaaaaagataacaactgctgggattttttttgtttttgtttgtttccaactgatttaagtgcatcacagaacaaagctaaaaatattaatagaaatataaaaatatctaccacccaaaaatataaaatacaaaatatctggcatcaatcaaaaattacagacctgcaaagaagcatgaaaataggatctataaggaaaagaaggattaattaataggaaccaactcagaaatgacaaattggcagacaaagacagtcaaacagttactataactctggtctgtaagttcaaagttttgttgagatggggaaaggcataatgagatccaaacaaagcttctagagataaaaattacaatgtctgtgatgaaaaatacgctggatgaagttaccatcagattagacattacaggataaaatattaataaacttgaagaaataacacaaacaattcttaatgaaatacagagaataagtgggggtcatcagtaaactgggggacaactttaagtagcttaatatgtaattagagtcccaaaagcaaatttttaaacttgaatgaatttctttaaaggataattggctatttacactgaaataattccaaaacagtgcagggattctaatatatgcaaacataaatctataacaagactagcataaagacaggtgaggaataaatgaacacatatatcattggaaggtttccataatctgagtgaagtcacttgaaggcagactgcgttaaagtagagatgcaactgaaaatcatagagcaaccactaagatgacaaaacacagcattatagttaataagccaacacaatacagagttataaaaatgctcaaataatccataaaaacaacataaaaagaaaaaaggaatatagaagagatgggattgatagaaaacaaatagaagatgatagacccaaaagtaaccacatcaacaatcacatcaaatctaaatagtctaaaagcacagattgtactattgaatattatcgaatcatatcaaaaaaacaactatatgctgcttatcagaatactatgaagactcagaatgtaaaaaaatataaaagtatggaaaaagatgtactatgccaacaccaattaaaggaaagccagactagtaacgttaatatcaaacaaaataaatttcaagcagagaatatcatctgagataatgaaagtcatatcctaatgacaaaagtattggtctatcaagaggttgtaacaatcaaatatttacgtacctgaaaatggatcttcaaaatcccaaggcaaaaacagaactgcaaggagaaacagacaaatccacaattataatcagagatttcaatagccctcttttagtaactggtttaacaagttgacaaaaacaaaagacaactaaggatacagaagatatgaactacaccaacaaccaacttgacttaattgacgtttacagaacacttcatccaacagcagcagaatacatgttctcttggagtgcgcactgattgtgtgccagcatggactacgtacactgggccataaaacaagcatccatgcattaaaagtattcaagtcaaaccaagtgcactcgctggtcacagtgaaacttcattaaaaatcagtaagagaaagatttctggaaaagtcccgaatatttcaaaattagataatagttgtctaaataactcataaagcaaaaaataaatcaaaagataaaagataatttacaattattttaatagtatattttggtcattttttttttctttttgaccaaatactggtgagaatgaagataagtaagacctttcttttttattttttttttaagacggagtctcaatctgtcactgaggctggggtgcagtggcatggtgttggctcactgcaacctccgtctcctgggttcaagcaattctcctgcctcagcctcccaaatagctaggattacaggtgcccaccaccatgctcagctagtttttatatttttagcagtgacggggtttcatcatgttgggcagcctggtctcgaactcctgacctcaggtgatccacctgcctcggcctcccaaagtgctggggttacaggcataagccaccacgcctggcccaaatctttcttttttggggtgagagtaaattgtaaaaccgtttttgatgagtaatttagcagcatacatcaaaagagttaatactgctaacactccttgacccagagtgttttttatttaatgaatttatttcaaggaaattgctatatatgcataaaatgtttgagaatgttcaacagaaaagaaattattttaaactgaacaaatataaaaatatatcaaagttggtatgatgctgccaaagcaggactgaggggaaactgaagaacaggggataattttctattcattctgaggccagaactactctgataccaaaacgagactaagagattccaagaaagctgctgactaatatctctcaggaacacagattcaatgatccttttaccattacagcctagagaatctgacaatatgtaagagggatagtacaacatggtcaagtagggtttatctcagtaatgcattgttggtctgacattcaaaaaacagactatgtcatttaccttatctgtatgaaaaatatgaaaagtatatgatcatatctatagataacttaaacatttgataaaattccatatcctttcttgaagaaaactgttatcaaactcagagtaacaagaaattttcttcacctaaaaaaggacatttatgacatcctatggttaaatagaatatttttgcaagcaaactgataagtcaaagatgcatatgtaattcccagatcaaatactagaaacagcaaaaagaggataaaatagccttttcagcaaatggttctagaaaatgggataatatggaaaaataatgaatctctagccttatctcactccataaccagatgtgggcaaactatggcctccgggcaaatttggcctttgtctgttttcatacagcccagaaactaacaaaaattttacacttttaaatgattgaaaaaaagtaaaaagtattttgttacatataaaaatctaagatattcaaatttcagtaaacataaatgaagttctattggatcatggccacagtcattcgtgtatatattgtcaatggttgcttttgcactacaatgacagaattgagtagtcgagacaaatactgcatgatgcacaaaactaaaaaatttattatttcaccctttacaggaaaactgctgacccttcccataaacaaaatttagtaagagacacaaaaaaaatcccagataatcgaaaaactagaaactgaaagcttcctggaagaaaacatagcaagctctcttcatgatcatggggtaggcaaagatttcttaaggacaaaagaatgttctaaccataaaaaaagcaaattgttctttatgcaaatcccaaaaagttcttcaaaatacattacgaaaaaataaatgtatatctgagaaagggctggattcatattataaagaattcctacacatcaatcataaagaaggcaattcactaaaaacaaaaagttgactagagaattaaaaaaaaaagatatataagtaggcagtttcttttcatgagactaatgtgtttatttctccagacttagatgattgtttcactgatagcatgtcactgtcagctgcctccaggaattatctttggttaaagggaatgctttgcccaggtctcaccccattcctatggcagctggcatttaatgactggctgatatctcccttcctacaccattatttgatgaaatttaaaatttaaattaaaatgaaaaatttttctttcttgtttagaaagacatttgctttatgtctccctcaccaacctgtgcaaaatttgagtttgaggcaggtaaacctgaaatcagcaagagctgtgctgtgtcctgagagatcccgatggtctaatttaggaagcacccagtctccctagtcagggtccttagagcttcctcatagtgactacacactggccacttgggggcactgtggatccactgagtgggtcactgatagcgctgtctgagagagagagggttaagggagacagtcttgatttcgtctctgtatcagggatattaccagatgaaccagaggtactgctggcacaggaagagttaatcatagtcttatcagatcaactgatatgcaacgtgtatttgtcatgacaggaagccatgaactgaagccttgtgtggcctctctagcaacctaggtttgatggggagtgtgatgagggtttcagcagggcagcctggataacccaagccaggtggagataaaggagcatctgcctcagatgaaaatctcagaagctgtgcggatggctgtctgcccggaagcctgccccctctgctcagcacagctagcttcccctgctctgcaggaagctggacaggatgggggaaagcctgagttagctgagctagtcctggagtacagggtgcctatgggagcctacaggacgatgacatcagaacagtgacatcacagtaaaaacctccaaaaaacggtgaggaggagcaaaagccctgctttctcaccccaggagaccagcaacctgagcagggagatgcttagtcctgacctgcctgactctgcctggaacaccaggctcctctgccatgtcatgctttgtctcctgggagcaggtgagtcctgagtacaggtgggacatccctgtatccacagtgttcaattgttgctgaagtgtcaaactctcccgagctgagtcttcagcttctgtctccttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagcttaggcacagaccctggagaattactggctttctgtacccaaaccctcctatctcacttgaggatgtaatagggagaaggaggtgggggctgccacacaactttagccaagccccagagatgcttctattcttttctaacattttcccctgccctgctgagctcagtgagagctcctgcacttgtgggctccagacccactggaagttctcacatcttagccagtactttttaattcctagcaagtggcgggagcttctactctgtgccaacataggggtatatgttttagtgtgtttcctgttgccatacagaatacctgagactgggtattttataaagaaatgaaatttgtttcttacagctctggaggctgggaagtccaaggtcaaggacccacatctagtgaggaccttcttgctggtgaggactctgcagagtcccaggtggcatagggcattacatatgagggggctcatgaaagatggtcaaactggcttttataacagacccaacctcataactaactaattccttctataacccattaatccatgaatggattaacctttatgagggcagagtccttaagatccagtcaccttccaaaggtcctacctctcaacgctgctgcattgggaaccaagttttcaatatataaattatttaggaacacagtcaaatcatagcagtacacattgcgggttttttttttttttcttttttgagacagggtctcactctgtcacccaggctgaagtgcagtggtgctgtgatcatggctcattgcaaccttgagcgcgtgggttcaagcaatcctcctgcctcagtggcctgagtagctatgactacagggacacatcactacaaggtgtgtccccagttcctcagttcctacaaggtgatgtgtccccttgcctggctaattttttttaatttttatttttgtagagatgaggccttgtcatgttgtccagattagtctcaaactcctcaaatgatcctcctgagtttatgtgttttaatgcaaagatagacattagcatatccactttatacatgtagaagatttcagtgtaccattttatagataggaagctgtggctcatgaacttctccagtatttcatatttccaaggatcaaaggcaggatccaaacctacgactccatgcctccaaaataaaatttctaaaattctatagtgtttcctgggccttggtcaatgagctacagcagagcactattcttccatctcaagactagccaagcagtagaagaaggtcacatattatggaatgtggttactatggcttatggcctgccaacctccaggacatataacttccagccagagaatatttgtcctgttttagttccatatagaatggggccacaatatgtcctaatatagacatatagtgacaaggggcatttctaatacatcacagggttcagtcaaggaaacagaatcctctaggaattccaaggagaataggagttaatacagggaattagtggttataaaccactggaaggctgaaaagtgggagggtctcagaaggttgaaacttgcgctcaggtccaccactagtgatcacaaagactgaagttgctacttttgcccaggtcagggactgctggaaatagctgagagtcatagtggtcttgcagtgaccaagagggtgattcacaggaaagtatccagaggtcattgcaaatccacctgtctgttgctgtcagataaaagtctttattctgcttctaacttttccacaagtatagcttactgggggaaacaaaactgttttcagaaacttgctctcaggagaatctaggaaatgtctttttcttttttttcttttttttttttttttttttgagatggagtctcgctcagtcgcccaggctggaatgcagtggcgcgatctcggctcactggaagctccacctcctgggttcatgccattctcctgcctcagcctcccgagtagctgggactacaggcacccgccactaagcccagctaattttttttgtatttttagtagagacggggtttcaccatgttagccaggatggtctcgatctcctgacctcatgatccacccatctcagcctcccaaagtgctgggattacaggcgtgagaccatgcctggactgggaaatgtactttcaagtcttctagctcttgcaataagagagagagagagattgttggaggacatttaagggtactcagtgccaaaagacaatcatcagcacacccagctatgcagcagagaaatggaaagcaggagaataaattttatattttctgtcaaattgttacatgaaaatttattttatatatatagctttgctgttgtcatttagttgttgtttacttgttaatttattcagtagatattcctggaatacctattatgttaaaaatttccttggaatacagaaaatgagatgtaatttttcaaattacacattctgtctttaagaagtctaaagtctggcaagataatatatccctaattattcacacatgcatttacaatgtatgaaagtcatttcaatcagtcagttttctggcaaggaacagatgacacagtcaaaaaggctgaagtgaaaacaatttaatcgaaggactatgtttagaggggtaaacagacttagggacaccaagaagtgtttgagggaccaggggtttccagcacattgggaagccagtacaactaactgtggggcctatggaaaaaggggtgggagggaaattctgtgttactggaggtgcatgcaagtaatgagaaaagtttcccaaaggaaggaattcaggaccagagctaggaaggggaagcccagatatgctgaactttctcttcactacccttcaatgtccagctggtgtcttccattggaaagcccagctgaaagcctggatagcaccgtttgctgacatcagtcttcaggggcacagtccagggcagtaaggggcaggcaggcgagagtcggttgtggggaactttgggtgtgcatgtagaacagccagcacagcagctaccaagtgtatgatgtgccatttgcagatgcatgtgcaagtacacggtggacagagaccaacttaattctacatcttttatgtgaacttagagaaaattgccttgttgattgctaataacaagcaacatcgttaatcccattttctctgggccatataccaagtacattatttcaattaatttcttaagaacttcaaaagggagaacaatttactcccatattacaggtaaaaaactgttagagaatttagattttctaaaggaggtacagctaacaaatatagaacttagactcacacctaggccatactgactttcaacctatgcttgaaggttactccaccctatacattttggtagaggaagataccttcaacattggaaatctaaatgtctcttttagaaacaatgcatctgacacaaaccatttgaataacatctttcatgtgggaggctgcacgctaaagaggaagatcctcagagatgaggagacctcagtagttcatcttctgatcccttgggtcagtgactttgaaaacatttggctaaactgaggccaatcatatatgtcttacagagattttatacatgtaaataaaacagagtctaatacatagtataggctcaataagtcttaggtccctatgaattttctgacaaatctctagtcaagcagttatttactttggcaatctggtaacaaaggcatacacgaattacttttgtctgattcacctatgattcagacacaaagtcatctaaaatgcaaatatagtagtctgataattcattggcaaaagtaacacaaacagttgtgtcttaagagaaagtgaaaatgttgtaccttacagcatttcctgcttgatactgagtctgatatgcaaggtgtgatgctcccagaaagttgtgaattcagagcaatcctgatggattccatctcctgttgctccagcacaaactcaatattgtacctttatcctggtttcctctctccctattttattctcccatctctcttattcctaattcctgagatcctttccaaaataaactactttcaccaaagtccatgtctcaaactttgccttcaggggcagcttaaaactttgacagtgatagaatgagatgaccctctaagacacttctctttgaaaaaggccgtggttttcttttagttacactgccatgcattcattcagaagtcctataatgatatatgaactatctcttccaagttcattttgactcagtctgagtttccaacagactcacatgggtctctgctcagttaaggctctgagcttatttgtaactgaatagactaagtttatgtttcacagcttcagggtctgcatggactcagagaaccattcatttctttcttcagtcattcaacaaaaatttaacaagagtatgtgcggagtagatccaagttttgcggaacatgaggcttataaaattttagggatcgctttgaaaaagagaatacaaaatgagaatgtcttgaaaaaattctgtgcaaggccaggcacagtggctcatgcctataatcccagcactttgggaggccgaggtggttggatcatttgaagtcaggagttcgaaatcagcctagccaacatggtgaaaccctgtctctactaaaaatacaaaaattagccaggcatggtggtgggcacctgtaatcccagctacttgggagactgaggcaggagaaccacttaagcccaggaagcggaggttgcagtgagcagagatcacgccattgtactccagcctgggtgacagagtgagactctatctcaaattaaaataaataaataaattctgtgcaagtgagaaggcctgaagttattcttcattgacttcatggcaaatccacttctagctagttaccgtgtgtaggcaccatgtaagtgcttgagaaacatcagcacagaaaacaggcaaaagctgcaaaataaggtgtatgttttcaacaaaagaaaattggtaaatcaataatgatcaagtaatacaaatgtaaatacaaggaaaatattcctggtagatgtttatctccccagagaagtcagagtattgttgagaattctattggtggatcacaccttatttattgatggatcacaccttattttgataacaattctcagagctcttggattccatgtgccctactctaaagaatctgagccctgagatggaaagctctcctttcctgtcctgactcaaccatgggcaatgatctctttttccgtgtgccttttggtctcccaggaccaggggagttctgggcatagatgggaaagctcttcctgggctttccaggccccagccacagcctctccatcggggtgttcatgggtcccctccctgtctccacttcagattctgtatccattctcactggagcatgagtgtaggaattacccacccaggttacatcaagatgtgcagtcacaaaaagggatcctcacactgagatgtgtcctgtatctgaaataacagtagtaccactattgactagatgtaaattttgcaccacagcacatttatggttcaatcaatatcctcccatttgtatttataagaccttctgaatggacacagggcatttccctatgaccttaaaggcaccaggctagtgtacttctgggcaaatatctcatatacatccctaatgagcttcctcttatttttacacaaaagaaaaaaaggagggtgggttttccccacatagtccatccactcacaagccaatctcctgcagaaataccctcacagatagaccaagaaatgctgttgtaccagctacctaggtatgccctagcctggtcaggttggcacctaaaattaaccatcacaaaactcatgagaacacagaggtctgagttctgatgatgagactcctattaggtgatggagactcaggtggcctcccctaaaacaaaaggagaagtcatatctgtattagtcatacatatgtgtatatgtacatacatgtatgtattctgttggttctgtttctctctgaggacgaggtggcctagatccttccctttctgggtaaagggtggaagcagtgtggatcattacttagtgtgttctgatagccatgtgtcactatgtacttgttctttgtgtcttcacatctcttcctgttgcattttaaagcattttcatagtatgtggtgttgcctagcagagcattctcatagcaaaaaaatgtatatatatatacatatgcatatatatattctattggttctgtttctctggagaaacggtatatatatatatatatatatatatatatatatactctccctgtatatatagtatatatatatatatatacactctctctctatatatagtatatatatatatactctctatatatatactctcctatatatagtatatatacactctcctatatatatagtatatatatatatacactctcctatatatatagtatatatatatacactctcctatatatatagtatatatatatacactctcctgtatatatagtatatatatatactctcctatatatatatatatatatatatatatatacacacactatatatatatatgggaagagagagagagaaaaagaaagaagagaagagaagagaagagaagagaagagaagagaagagaagagaagagaagggaagagaagagaaggaaagagattagggaaattggctcacgtgattatgaaggctgaaaagtcccccagtatgccagccatctgcaagctggagatgaagcaaagccagtagcatgactcagtccaagtttgaagccctcagaccacagaagccaatgttgtgtctctcagcctgagaccaaaagcctgacaacccaggggattgctagtgcaagtcccggaatccaaaggtaggagaatctagaattctgatatccaagggcagtagaagacacatgtctcatctctgagagagaatgcaaattcaccctttctgtgcctttttgtttcatccaggcccccagctgactggatattgccatacacattgagagtagatctttcccacacagttcatcaatttacaagccagtctcctccagaaataccctcacagacataccaagaagtgttgctgtaccagctatccaggtatgccttaatctagtcagattaacacctaaaattaaccatcaaactaccagcgggaacacacagaggtctgagctctgatgaggagtctcctgtgaggtgaactaatgtgacagggcataaaacaatatacaaattgtattgatcctgaccttaagactttttgaaaccttcccagatgtcaggtggctcttttaacagaggccagcactgtaggctgacatccagttatccagagtttgagaaaagataaaatctagtaaaaggtacttagaggcaaatttgaggagatgagttataaaggacaccagactgccacgagaatgtcccttagactacataaatattagaaacaattaaaacagcatataaatgaggaattgtatcctaatgggaataaaatatgcagagaggaatgcattttctttctaataacctgcaaagagcatatgcacttatgtctttaaaaatagtctacaaattattcccattctgagctgttaaattgtatatatgtcctataaaatattgttgtatataccataaattacatatatgtatatatttgatttatttttttggagaatgtaaggggtgtggcaggttaactttccagctcaactatttgtcaggggcactgatgtcatcgagtcactgagaacctaagttctatttccccaggcagggctgggagagatgagatcctggcctggacctgaaatgggcacaaggttgttcttctatgtggccctttgtctcctgtggacaggtgagggctggtcacaggtgggcttccttccctagaattcccaaggcctcaatacaagtctttttcttgggattacaacatcagggtctgttgttttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgagtccacagtgctgcatggctgcctcctctctgcacgtaaacagcagttagaaagactgaggttgctctgtgtctatccccacccttggaagtccaggcctccatagaagtcagagggccctggccagcctggaagccatagagcaggggccttatgaccctcagtgctgacgtccattcctaccccagtctcagaccaactggaggtcaccccaacacacttagcttgccaagtctctcttctgcagctctcttttgctgcttgcagaaaggaaaaggcatcattagttgaggttagcgatgattctcttaaccccaaagcctggactcccttctctcccctttgggcttcagtgacttcttcatctgcccctttccccagctccactatccttccactcatagtcatgaaccttcactcctgacctctgttcctggctgcctttcttctatgggccaatagcctcatggggccctctatcatttgctcttcacctacatctccatcatcattttgcacaagtctcccctggctctctctgctccagccatgctcctttatgttcagttatttcctcatatgtgttatgctgtttcccaccctggggatgtgtgtttttacagattatttcttctacactgaacatatgttcctccctcttattcctaagtctctacttcatttcttacatgaaagtatatttcaggtacatttactcttaactataaacagaaaaacttaaatttcactaaaagaaattaaggaaaatatttttatcctttgagtgaagacttttttagtggaaacacaaaagaacacatgccataaaaaaataatactggatgggcatggtggctcacacctttaattccagcactttgggaggcctaggcgggtggatcacttgagcccaggagttcaagaccagcctgggcaacatggcaaaacctcgtctctactaaaaacacataaattagctgggggtagtggcgtttgcctgtaatctcagctactctggaagctgaggcacgagaatcacttgaacttgggaggcggagggtgcagtgagccgagatggcaccactgcacttcagcctgggtgacagagcaaaactccatctcaaaaaataaaacaacaacaacaaactgacattagttgtattaatcatgtatcgaaacacatgataaaaaatgaaaagtcaagccacagcctggaaaaggcataaggaatgcatgcaaatgaggaagaatcagcatgacaccatttatgttcacaaaagtcccttggctcccctacagttccaggcttcacatgcagttaaagtgctgggaacatatgaagaggttctgaataactggatgtgtgcagaactgatgtgggcaatcccaagtctggcccttagaaataacttgtggcagccacgcgcggtggctcatgcctgtaatcccagcactttgggaggctgagatgggcggatcacaaggtcaggagattgagactatcctggccaacatggtgaaatcccgtctctgctaaaaatacaaaaattagctggatgtggtggtgtgtgcctgtagtcccagctacttgggaggctgaggcaggagaatcacttgaacccaggaggcggagactgcagtgagccaagattgcgctactgcactccagcctggcaacagtgtgagattctgtctcaaaaaaaaaaaaaaaaaaaaagaaataacttgtggcactgtgaagggagtcctcaagtagacacagaaattagctgcaaagactcatgggatatagcatacagttgcacttatggttaagatttattacagtgtcatagtaaatattcagcagcggatcatatgaagaaaacacacaggaggaatctagaggagttcacacattggcttccttatgctctcttcctcccgggaggggtcacacagagctcacttcttccagcaacaaaaatgcattaacacgtgtgcaatgtttctgcctgtggagctcatcagagactcaacaccccagaggctttagtggaggccagtcatggaggcactcactgcctagtatgaacccaaaatccacagcccagaaggaaatctcggtattcagcacaatactgtttgcaatatcagtctaggccacaatgagctactcctctcggttaggagaaactatgtcagtgcagggcactgctcaccagccagcttcccagatgtcagccaaatgccaacctcacaagcaggactttctaagcaccacagtctcaagccttgctgttgactgttttctgtacagatcccttcaattcttttgccatgccctaataaacctgggagctacgcaatacagattgactaatgataatatggaagcagcctggctcactgggtcataatttggtgaaaaaccatgaaagaaagctacttatggcctgctgggctttgtggacatgggaagtaagacttcatagaattaagccaatgagattttaagatttatttttatttttttttctgtagcatagctgttcttatctaatagagttagtatctacaatgggtaaagcattctcataacttactaagacaatccaataaaatggcaatacttagtctaaataggcatttcacagaaaagtaaacataaattaacactaacataaaaataggttcttgggctaggtgcagtggttcattcctgtaatcccagcactttgggaggctgaggtgggcagatcacttgaggtcaggggttcgagacaagcctggccaacatggtgagaccccatagctataaaaaatacaaaaaattagccagtcatggtgggatgtgcctgtggtcccagcagctactcgggagactgaggcacaagaatcacttgaacctgggaggcagaggttgcggtgagccaagatcaccccctgcactccagactgggtgacagagcaggactccgtcttaaaaaaaaaaaaaagaataggttcttaacctcacttagaatcagagtattccaatctgaaacagtaaattatgaatgcaaacttatcagattttgaagactggaaagtcttcaaagaaatgatagtcccaaatatgagaaaagatgtggactagtggaactgtattatactacagaagaaaattataactgatatggttttgttctgtgtcgccaccctcatctcaaattgtaatccccatgtgtcaagggagggaactggtgggaggtgattggatcatgggggtggttttccctgtgccgttctcctaatagcgagtgaattctcacagggcctgatggtttatgagtggcagttttcccttctctttctctgtcctgctgccatgtgagacgtgccttgcttcccttctccttctgccatgattgtaagtttcctgaggccttctcagccatgtggaactgtaagtcaaataaacctctttcctttataaattaaattacccagtccctggtatttcttcatagcagtgtgaaaacagactaatacaataattatatcagaaaaccctttctgagatatattctgacaagcaacattttgaaacaaattagcaatatagttgaccctctatatcagctgatttggaacccaaggataccaaaggctgacggtaaggaaggtgggcacccttggattaggatatcagcagggtttcctggaaccaatcccctcaggatactaagagatgactgtgtgtttaaattacttgagttcctttcattgtctttagggtccatcatggagaattgagttgtcaatatttattttagccattttgaaggttttaattgatatttaaaaattaacacttaaaaactgtggttatacatatatgtataaccatggttttacatatatatatataatatatagtatatacattaccacagttttatatataaatataaaatacatattaccacagtttttaaatgttaatttttaaatgttttatatgtacataaaacatacaatttttcaccttaacaattttaaaatatacaattaagtggaatcacgtacattcacaaggttgtagaaccatcactgctgtttccaaatgtttttcatgatctcaaagagaaactacacccattaagcaataactccatctttcccatgcttctcagcttctggtagcctctaatctaccgtttgtttatatgaatttaccaactctagatagttaattgatgggaaattataaaatatatctccctttgtgtctgtcttctttcacttagcctaatgctttcaagattcatccatattgtagcatgtgtcagaattttactcctttatatagctgaataatacttcatcgtgtgtatagaccacattttgtttatctcatcatcagctgatggacttgtgggttgtttccaccttttgactattataaataatcttgcaataaacactggcctacaagtatctgtctgctttcctgctttcaattattctgggtgtatacctaggggtggaattgctgagtcacatgggtattctacatttgacattttgagcaactgcccaacagtgttttacagcagcctcagcattttatattcccataacagtgtaaaagccttccagtttcttcacagccttgccaacacttaatttctgttttgttcttctttttaaaaattattacagccatgctggtaaatgcgaagtgatacctcattgcggttttgatttacatgttcctaataattaatgatgttaagcatctttttttgaacttttactttaaatttgaaaattgtattatgtatacttcaggtacataacatgatatgatgagatacacacctataggaaaatggttactatagtgaaacaaattaatatagccatcatctcacatagttacccatttactccctgtggcaataacagatataatttactcatttagaaaaaattctgaatatatgaactatagttttcatgtggcacattagatctttagacttcttcatcctgcctatctgctatcttgtatcatttggcctaaatgttcccatttcctattccctccccctgccatcctcccattaaccactatttcattctctctgtatatttgagtttttacaaatttcacatataaataatatacactatttctctgtgtctggcttatttcacttagcctaatgtcctccaggttcatctatgtttgttgtggtaaatggcaagatctcattttttttttaggatcaaataatactccattgtatatgtatgccacagtttcttcatccatttgtccatcagtagacacttaggttgtttccatatcttggctattgtaaataatgctgcaatgaacatgggagtgcagatgtctccaaaaggtgggatttcattttctttgtgtatataccaagaaaagagattgctgggtcatataattctatttttaatttctttaggaacatctacactaattttcttaatgagtgcatcaatctacttttccaccaacagtgtataaaagttcctttttctctacactcttgcaacttatctttttaataatagctatcttaatgggtgtgaggtgctatctcatagcagttttgattttcacttttctaacatttagtgatattgaacatcttggccatttttatgccttcttggtagaaatgtctgtttaggtcctttgctcagtttaaatagggttatatgttctcttgccaaagagttgtatggggtctttatatatttggtatattaatctcttatctgacatatggtttgcaaatattttttccaaatccataggttgccttttcatgttgttgattgtttaatttgctgtgcagaagcttttcagtttgatttagtcccatttatttttgcttttgtagcctgaactttttgtatgatatcgaagaaatcattgccaaggccaacgtcaaagagcttttccaacatgttgcatgtaataaactgaacttagatagaagacctaaacattagatattaagcatcttttcatatattattgatcatttgtatatcttcttaggaggcaatggcttttcttttccagttgttttttagtttttctttgtctttagattttagtagttttatgattgtaaggctaaatgaggttggggttgaacttcacttgggagatttgtcgctgttagtgtttttagtgcatattctgaaacatttttaatagactgtacaacagagaataagtaaattcattgacattactgggaaacagagttcttacaaagggaagagagatacaataagaaatagggaaagacaaggaagaaatctgtggtgtttatttgaattggaggtatcaaatatgaactattatttaaaaattatgtatttcctaactctaaccatacaatatgtaagaagcaatatgaagtcgatggacaattgctttatttctttgtacttgtgttcccagtagtaatgggcagaattattgcatgttatttaatttctaaatgtttctaaaagaaacaaagcagaaatggcttcttctagatccagagcagggaaagtcaaaaacatcttttggcagaaatcaaggaagtttcatgacccagaaaacatagaaaaaagccacagaaccagtttcatggggctcccactagccaaacacgagtatctaaacattagagcataataatgaggacactaaattataacaaattttaaaaatctataaggctataatgacaataaaaagatgtaggtaagaatgtcttcattacagaataatgctagttactaaatttcattagaaaatcaatgtagccattaatgtagttacagacagagaccatcagttgatgtcaaaaccaacatctgaaaggttattggagaccaagatatctatattgtgtcaaagtatcactccactaattgcttattaactataaaatataaatgatatctttgcaatggagagatctgatgtctgtgatgttaaatttagtatcgccaaaaatgtgtaaagacagcattatatgttcttgtaattgatcggatgcaatgggaaacacacatcaactatggcatggtatttgccaaaatatttaacctctgataatgtggaaattctgattgggggtcattttaccagtcagctgacatggactcttacaaaaatcaagaccatgaaagttggaaaatataagtgggccaaagagatgtctagtttaaaagtagctaaaaagacctgacaaccaaaagaaatgcataatctttgataatgtcctgtagaaaaaaaattaaaaccaaaagacacattggtacaactggagaaaggggaatgtgaagcatatatgagaaaataatgttatatgaatattaagtttttgagtgtaataaaggcatttgtggttttctaagataatggcctctttttaggagagacatactgaatcgttaagaataaagtgttttatttcagaaattgagggtaaaatacacaaaaagagataaagcaaatgtcaaaagatgttaataattgaaatacattttaatattctctttgttgtatgattcagctcttccaaaagtgtcagttttttaaataaaattagaagaaaaaaatcttaagatcttgaaatgttggcatgatttcagttttgtggtggctatttattatattcattttcaatatctttgaaatattctataattaccataaaacaaacacacaagataaggtttcttttagccctatagtgtactttttctatagggacaggctatgatttttaaaagtccccccaaaagataagagaatttatagtctgaggacaaaatagctgatatctctgagatgagcacaaaacttagctaacaatgcatgtcaagaagctgtttagtaaatacacaggactgttttaactgaaacaggagattctgagttccctacaggttggtcaagaactcacagatgttggggaattgcctgaatgtaagcagaggagtggtagtgcttgtcctaaattgtggttggataatatgtgtttgtgtaacagggagggggctctagcaggactgaaacactgtctgtggggaggagtctctagcaggacagaaggatcacatggagctggaatgaattcccttcagtcccccacaaacactgtctgatagtagccctgatctaatttccattgtttagaagtcccaccactctccctgagccatggctggagggcctaagcccagtggctctgaaccattggccatcaggaggcactgaggtttgatggcgtccaaatgtttttgaaacagggctaagtattgcctgagaagttgagtttaaaggaaaagtgtggcttcatcctagcattcagtatctagtttgcaggtgttttgagtggtcaatggaaactcatctttctccactgatgccagtgggttctgttcggcagtgaaatctgaactgtagcaaaccattgagtggagaatcttctgagcccacttgaggggtagatggaggagagccaggagccaacctgaatgctcacagacccatgcagaggaacaagtgcctccttgggagaacatcagagaaaccttagcacctaacctattctagtgtgtcctggacgatggacaggagaatgtaaggggaatgtagaagatgggagtggacaactgtagatgtttccagatatctcaaattgcagtaacaccacaaatattcttaacaagaaccagattttccagaactctggcatttccttccctgagcaatgagacggccctttgggccctgacacaatcatgggtgttttttgttcatttgttttggtgctcaggaagcaggggaggcatgagaatacctggggaatgtctttcctagaaataggatgccccaatttcaagtatttcacatgcagcttgataggtcctgtctccagccacccagcctccactctctcaatgctgttgtcatccagggccctaagctctggtcacacggacggaagaggtagtgacactgtgatgtgaagacactttccaccatgaaattattaattggtgtcaatataaggcaggctccgactagcagcttttctaccacaatgatagacaatttatatggaaaagagatggttctgataattctacactcacaggtcttcacctgataaccttgacatgtgtcccctaggttttaggaacttggatttctttaggctgagttgtactattccctttctctgaacacacatgtcattggttagttcattcatattgattctcagggcttctccaatccctcaagccttcccactctaccactcagataaggagaagtgtgtcttaactaatgttgcataattttttaaaaattgctggatactaacactgcaattcaattgtaaaatatgatagaggtgtaagtgttttagatcccagaagtcctgctcaattttgcatttattgttggatattcaccctgatattttcaggaattagagtgttcttcacccatttgggttaagatatcagaacttactttcaattcattggtgaccagagactacaggcagaatcatagtgaaggcttgatacataatacataatgaagattgataacagcaaaaagggaactagtcattggccttcagataaaatgaaacctcccaactttgtgctcagggaattattttacccctttaggttagagtatgtcagctagttcaatgcagttctaggataaagctgtgtcaattaccctagaggactgggagcatggaggacctggtagaaaagaaatacccaaagagaaggaaaattacacacaaaatcaagaggtcactaattgatatatctattttgagttgcctttgagacttccacgtagaaacatctagcacaggataggcctagagatgtagtgacagatctaatcccccaagccctgaatatgtgagtgaggacgcttggatgaacttccagtctatgaatacattaaacaaacttttagctctgttttagtttacaacaactgttttctaagaacttaagcatttgtggagacaatgatgtcactgtaggaacttctctgtaaggacagcaacatcccacttcctctgctcctgctcacagtgaccctgatctggcaaagcttccatcctgccctgaccctgccatgggtaccaggctcctctgctgggtggccttctgtctcctggtggaaggtgagtcctaggaacaccatgatcctcacataatctcccagtgattattctagtcatttccttctattttaaaattctttttcccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagcttagacacagtgtagcagagacacttccctcctgtgcagaaaaccgcaggactctctcctctctactcagctcacagcagcctttccttattcctcatcctcccaggaaagaagtgagttttcagatatagctaggattcatatagtgggaggaaatgaactatttcttacaacatgagcgctataattgttgcttgaaaatgtgtctcagggatttgaaacacttcttggggacaactcaagaaacctaaagtgacttatcagagattgagtcctcaggggtagtgatggtttatctcccataaaagtatgtgatcatgaaacatgtacaataaacttaataatacagatagtgattataccaagcagcaaacagcaggctccccttatgtagttgtcagcatgtgaatgacttgttacccttagtgacaccccggctgtctagcaaagtctcaacacacagtatgtgtttggaaatctttttccttctgttttatttttggtaaagtatgctaataatgatgttgttaatgatagtgattataatttcaggtatgttattcagccctttttccagttcaaagaaatgcacacaaatggataccccggcaaccaggtgcaaatcttagctccagatgaattctacttctcctgaactctctaactcttctatgtaatcatcccagcccaagaatatatctagacctggaccagtcagttcagaggacatttctacgtgtctgccttgtatattaaaagttccttagtggattgaaatattccttgtaagaacttctgaagcaatcaattgccctctctgataatatacactctgtgtgtctagctccatattcattactctacttctgcctaaactctctaatactagaaatctttctgaagtattggttagaattacttaaaaagcagcatactggaaattgtctgaaagcactgtcactgtccatttgcccctcctgacttccctcccctccttatccaatctaatacctgatggcaagtcaggctttatttccatttgttcattgcacatctccctgtcctttattcctgtaataaaacctcactgatgtgatggattaaaatgaccactcactcaccatctccttgtcaaaatttctatttttttcttttcccaatctgctatgttagttatagttaataactccctcataacattttctgagatcactttttattatttgaatataggacacacagttgtttcagagtctgtctgatcattttcacctctaagatcttcataggatatttttgtgattttctttttgtgctgcttctcagttatggtgcttgagttttcatggcatttgtatttctccttaccaatctgatgatgtttgacactttgccaaacactatagttgtagaaataattttgggggtaggatggatatttttctgcagagatcatttttctgtgcttctgaaagtgcatgtagatataaacagtcaggctccctgaatcacagtttaaggcttgaggtgtcctggagcatctggagaacaggtttgtctctggcttattgttactagtggaatttggcaatgacacgttcggtatgttctgggctttgctttacccccgtggcctgtgagtcagcttcctgagtgctgagtcaggatctgcaaatgcccgctagggcaaatggactgctgtgctcacctcccggagctcttgccctcaccaacattccagcccaattattattatttttttaggactttaactaaaatttttaatgttgtttttgatattttttttccaactatgtagataacaacagaaagagtgagtgccattatccttaattattgggattaaggtgaaaataactttacctggaattctaattttccttgtattttaatgttagattctttgtgatttgtctaatattcaacttaaatggtatagagatgttaaactctgatatcaaatactttaaaaaaacttatcaagaccattcataatccaattgagacatatctttgtttggggcatgttgtttttagagtattcttctactgttatttatttctatcacataacctctgtgttccattggaccatatggcaagatgggaaagacaatcaagagaatgctgagatctggtcaaatagtacagattgggcttcaaattaatttaattactgagttctgggggtggatttgtgctgttttatgagtatttcctggggcaatggtcaaaattagagggagtaactgatatgtggctattgttttaccccgtttaaagccaatctcctgggacaacacaccccattttgtggggcaccccgaaagtaataatcctgttttaatcttcctattccttgccaaatcttctctacagaagggaaatcagttatactatttcctctcttcattttagtttagtctctccttattttcccgttttcctcctggttccctagagaaaagtagattattttcaacatgtgctaagatcagtgaggaactctctcttccatgcagggtggcctgcagtttggaggggatagggaatgggttaaattctgtttcagcatcatgttagccagcccatcgagtttcacaatgagacctgctgcttatcagtattaaaactgacattatgtttccacctttctgactgcattgtcaatgtctggggtgtttctgtcctaccccatagcactaatattatttgttggccttttaacaccaactaatcataatatcctatatcccttgtactcagtgaaataaagctcaagtccctgtgtcctggcaaaagagagcacatttgtgctgttctgcctactggccactaggaggcactgtggcttcgatgtcatccagagtctatggggaggagctgagattgctccctggaagatggttaagaataaccccgaggttggacctaaattcagggagttggtttgcagatgtcttgaatgatggctgggaataaaggaattagtaaccgacgcttcctccattgtagaggtgggttttgctttaaattgtgctttgagtggggctgagtgacaggtgtactttgcagtgcatatacctctgagctcgcttaagatgtaggggcacaaggagctgaggtggtgcagggcccatgttctgagcttggaaaaccagagaagcagttcttgtgtcaaaggagccttggagagcctggccccaaaccagcccaggccaaccctacctgctctgtgagagtagaacagcaagaaagggaggtgctacccaggaccacagcagagggaccctgtcgccagggagatgaaaatcacagtgatgccacgaccatatccacgtatgaggcatagtccagtgtgtctcctggaagaagatgaagcctgggcagacataagaatatgtttttgaataggcttcccttggcctgattttaaattccttccatgtgatcatgcatctgtctgtacctgtattttgtacccggcttctgcctctcacccatcagtcccatggctactagaaggtattaaatttctattgacaaaaattaccactaatttggtggcttacaacaataaaaatttattatcttacagttctggaggttagaagtccaaaaccaggctaaaatccaggtattggcagggctacattccttcccgaggctctcagggagaactatttttctctcctattcagcttctagaggccaccagtgttccttggctcatggccccattcaatcttcaaagccaacaaggactgggtgagcctttgctcactctgcatcactctgacactcactcttcatcctccctcttccacattttaggacccttgtgattacattgggcccatctggaaaatccaggacacgctccccatattaaggccagctgattagcaaccttcattccatttggaacattcgtttctccccttgccacataatttaacacattcccagtttctgggaattagacatgtacatctttgagaggtcgtcacgctgcctgccacacttgctacctggttacacgaagtagtaagcaattaactttttgaaggcagaattatggccatagttttatatcctggatccaacagaccctgcaaaaggatagagcccacatggaaatagcccctccagtaacacaagctagtctgcaaactaatgcccttttactttgggaagtgcttttgactgcaggggactcagaagcatgcctctgtgccaacagcaaaaatgtgcccttctcttttgttggcaagtaacttaaccaaccaacccaaaaaaaagatctttctctcagctttccataatctctgagacgaagtaggtttggagaagtggggttacaggggaaaaagccaggtgttaatgatgaaaaaacattgaacttttctaggggtagtaataagatttaattcaagactagaacattttagctgcaaatcttcaagaataagacaatattatcccctttctgttttattgtgggactagagaatgtgagagaggttacattccatgggctttgggaatttaatatggttcaaggataaacacacccaggtttttcactgcagagaagagcttcaaatataatcagttttcaggtcatcagctcagctcttgtatccctaacaatgcagttgacatgcgtcttctcagatgtctaactcctaactcactgagggatactttaagtacatataaaggactagaagcaccaagctaccagtgagaggaagaggagagtttgcagagaagctggcttgaaataagacaatgagttcatctttaaatacttgccatttgaggtgcagatggatatagttggcaggctcctatgtaaggcatgttatggagaagctaccgtgaattgataatatcaaaacaaatatccagggagcctctgcaagtgtgcatctctatttcacaccaattatagttgagttaattcctgcctgattcatctcccagagatgcagcctcctcttaaagaagttgggggtggtggcccattcagtgatgtcactgacagatgcattctgtggggataaaatgtcacaaaattcatttctttgctcatgctcacagagggcctggtctagaatattccacatctgctctcactctgccatggactcctggaccttctgctgtgtgtccctttgcatcctggtagcgagtgagtcttcagaatatttgccatcatcaggctgggcttctgcatggatgatctcatatattttccttattctgacgcccaattctgtcttctttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttagccacagcgctgcagaatcacccctttcctgtgcagaaaacccggtgtttccccttctccttctacctcccagcagtcctgggcaaagtctctgctgttcctccctccctatgagaaaaaagtggtttgggggtatgaaaaagacagaaaatgagaagggatcaacataggaaaccttatgttggtttgaggattacaaaatgggttttgaggattccttaaaaattgtctctgctcaaaacacataggagtaagataaaccttggctactgacactggagatttccctgccctcctgcatttgccatcccatgagaatggtgggggctcttgagaagggctgcattttctgaactgtgaggccctcttcattctctcctaactctaagctgcaaacagaaatttccctcacacgttttctagattgtaaaagaaagttcttctttactatgattgtggacgttcctttataatgccaatttcaactttacattacttcaggatttttcactactcctaaagagtgtctcaaatgtggctagagcaagcaggttagtacactagatgtaagctacctggcctggaatctaaggatccatttgtctctgttctgcgtaagatgagccgggtgctggccaaaggctgtgcacactcacagagcactgatgacgcctcctggtaaggacccacactggggtatctaaaagcagacaggcatgtccagtcttctgttgccctgtttcctttctgattatatgtccttaacacacaaatttacattttccttcttatttatatgagaagtttctatacaatacctgcaatccattctgagtggttataatttctgtgtgatattcatatttacatgctgattccttctaaatacctatcatggtatcattgacaactgaggcaaaagacccctatattttgagtgcccaaggccattgaggttttttggagctctgccataagcccaattccactgtgtcattttcctatttttctttccttttttgttttttgattagtgggtcctgactttcaagatgaaaatagtgcagaattcctccctgctgcttccagatcattttccttcctacttctctaaagcccagctgcattataggcttcctttagcctgattttaaattccttccatgtgatcatgcatctgtctctacctgtatcttgtatctggcttctgcctcttacccatcaatcccatggctactagaaggtattcaatctctgttgacacaaattactactaacttggtggtttacaacaaaaactaattatcttacagttctgcaggtcagaagtccaaaaccgggataaaatccaggtgttggcagggctgcattccatcctgaggctctcggggagaactgtttttctctccttttcaacttctagaggccaccagtgttccttggctcatggccccattcgatcttcaaagtcaacaaggactggctgagctttgctcactctgcatcactctgacactcactcttcgtcccccctcttccacattttaggacacttgtgattacattgggcccacctggaaaatccaggatacactccctatattaaggccagctgactagcaaccttcattccatttggaacattcctttctccccttgccacataatttaacacattccagtttctggaattagacatggacatctttgggaggttgtcatgctgcctgccacacttggtacctggttacaggagtggtaagtaattaaattttttaaaacagaattatgaccacagttttgtatcctgggtccaacagacctgcaaaaggatagagcccaaaggaaataggccctccagaaacacaagctagtctgcaaactaatgccctttaacattggcaagtgctttcaactgcatgggactcagaagcatgcctctgtgccaagagcaaaaatatgcccttttatggcaagtaagttaattgatcaactcaaaaaacaaacatttctctcagctttccagaacctctgagaggaagtaggtttggagaagtgggattaaggggttggcagggggcggagaaaggtcaacaggggaaaaagccaggtgttaatgatgaaaaaacattgaacttttcttttctaggggtagtaataagatataattcaagactagaacattgtagctgcaaatcttcaaaataagacaatcttatcctctgttttattgagggaatagagaatggagagaagttccattccacgggctttgggaattcaatatggttcaaggataaataaacccaggtttttttactgcagagaagagcttcaaatataatcagttctcagggcatcagctcagttcctctatccctaacaatgcagttgacatgcatcttctcagatgcctaactcctaactcgctgatggataatttaggtacacatagaggactagaaacaccaagccaccagtgagaggaagaggagagtttgcagagaagctggcttgcaataagacaatgagttcatctttaattacctggaatttgaggagatgtatatagttggcaagctcctaggtaaggcatgttatggagaagctaccgtgaattgataatatcaaaataactattcagggagcctttgcatgtgtgcatctctctttcacaccaattatagttgagttaattcctgtctgattcatctcccagagatgcagcctcctcttaaagaagttgggggtggtggcccattcagtgatgtcactgacagatgcattctgtggggataaaatgtcacaaaattcatttctttgctcatgttcacagagggcctggtctggaatattccacatctgctctcactctgccatggactcctggaccctctgctgtgtgtccctttgcatcctggtagcaagtgagtcttcagaacatttaccatcatcaggctgggcttctgcatggatgatctcatatattttccttattctgacgcccaattctgtcttccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttagccacagcgctgcagaatcacccctttcctgtgcagaaaccctggtgtttctccttctccttctacctcccagcagtcctgggcaaagtctttcctgttcctccctccccatgagaaaaagtggttttgggttgtgacaaagacagaaaatgaggtttcaacataggaaaccttatgttgatttgaggattatgaaatgggttttgaggattccttaaaaaattgtctctgctcaaaacacataggagtaagataaaccttggctactgacactggagatttccctgccctcctgcatttgccatcccatgagaatggtgggggctcttgagaagggctgcattttctgaactgtgaggccctcttcattctctcctaactctaagctgcaaacagaaatttccctcacacgttttctagattgtaaaagaaagttcttctttactatgattgtggacattcctttataatgccaatttcaactttacattacttcaggatttttcactactcctaaagagtgtctcaaatgtggctagagcaagcaggttagtacactagatgtaagctacctggcctggaatctaaggatccatttgtctctgttctgcgtaagatgagccgggtgctggccaaaggctgtagcacactcacagagcactgatgacgcctcctggtaaggacccacactggggtatctaaaagcagacaggcatgtccagtcttctgttgccctgtttcctttctgattacatgtccttaacacacaaatttacatttttcttcttatttatatgagaagtttctatacaatacctgcaatccattctgagtggttataatttctgtgtgatattcatatttacatactgattccttctaaatacctatcatggtatcattgacaagtgaggcgaatgatccctgtattttgagtgcccaaggcacttgaggttttttggagttctgccatatgccaaattccactttgtcattttcccattttttttttttttttacgtgtagggatcctgacttttaagatgaaaatagtgcagaattcctccctgtgcttccagatcattttctccctcctactttaaagcccagctgctttgtacatattactttataatattaccccttctcattgtacctaccttattaccttcagaaattttcttttttttaatccttctgcctgctactaatccagtcatcattcttaatactattcatcacatagacaatttattcactcgcgaggcttctaagtttctcgacttcctatatcctgagtctttttcccctctaatcattttcagacttgtttccatgattatagaccattaaggaacaacaaagatctttcaatatttctatttaaattgtcctgtcgttctaccactacctcccttctgtctatatcagtaactcctacaattcttctatttctctgacctctccagttcatagagcccataacttttatttttttaatttttttttggtctttctaggatgttatttattaaaaatagattctctgtccctaccctcacccctgctggcaaaatggcctttcccaacatcttttcctgcatggataacaggtcttgaggacgcagatgtgcatcctacctaaactacaggctcaggcttttctgggacagtgaggcagcagctctgccagagccaagggtggaacagcacaagacgacatcagcaaaccctggtgcacctaactgtgggctgctatggagtctgggatggactggagttcctcctgctccaggcctcgggagacaaaatccacaaagagagacccagtggcccagcagcagccccctgagagcccacaactttttaactcttacgctttaattcttacattcttttaattatattttaagatttaagactataatatcaaccccgattaaagccaactccccgtaggttcctatgaatggcagagttgggaggggcactaaaaaatccccgtgggaactcattcgatttatcttctgtagttgtcatagactcctcttaggttcctctacttctaatcttggcctccctcattctagccaccaacccagggtctactctcaatacagaagtcagagtgatcctttaggttagatgttgtcactcgtccactaaaccatacagtagattcccgtttcactcagagaaaagcctacagcctgcataggcctacgaggtcctcggtgatccccctccctgttgtatttcttgcctcctgtctgttcctctttcccttgcttattttttcacaacacagtggctttctggccattcctcgaatacacaaggcacacttctgccttagaacctttgctcaagctattccctttgcttggaacatccttctcccaagtatcccagtcaggcctgcaagaagcctgaattattctaccagtgacacaatcattttcctaaaaccacttttcaatttttatacattcaacaattctccattgttcaccagataaaaatgtcacctcgggagggcatttgaattttaaaacatttggaccatatcttatcttatttttgactactgagtaagataaatgttactttatcaagtgcacttcatacccttacaaaacagtcttacacaatttaatgcctgttcatacatttgttcttgcaatttctgctaccttcttcatattgttcaatacttctagtcactcaagacactactgaatgcttctttctctatgaagcaggaaatggttctatatactctattttcacagtggagtaaaatagatacacattttaggaacaaaacaaccatgcagattatagaaattaaactattttttacatactttcgaaggtgaggaagttcagaagctcaaatatggttaagatatgttttgcttctatttaagtccacattccccaccactttaaatcttccaagaaagatttccctcattcaaattaaaaacattttgatacaagactgggggcagggaagtgctgggtagagaagggcggggtccctggtgagggctccaccctcgggcctgtgcccacagacctaaatgaggacaggcgtttctgtttttgcactcaaaaagttgccttttggcccgccacgcctcccatcctgtgcccatataaacccgagaccttaagcggacacggacacaagaggctggacatctagaagagcagaagaatacagcagcagacaccggcagatcagcgatggcggaaggacacgaatgcgaggggagttcagccaggggaagtctgcgagagtcctgccactgggcagccaactgcaggggaaaaccaccgttccactccatccctcgacttctggctccccatctatctcactgagagccacttacaccacttaataaaagcttgcactcaacctttcagcccacatatgatctgattcttccagtacactggtcaagagctcaggctgtcacattggccccctgtccttgcaataagcagagggtctattgagttgactaatgcaacgagacggcagacggcatagctgaaagagtgcactgtaagtcctagacgctgccatcccttggagcccaaaagcactccccatggcctctgcacctgcccgtctgcatgctcccctaggggtttgagcactggggcaccagtgaagtgagccatccccctgtcacatgtcctgcgaggagaataagggaattctccggttttaacttaatctgtaaaagaccttgttaagaggatgaaaaagaagccacagcaatggataaaacatttgtaaactacatatccaacaaaggaatattatgactgtttcgagatttgcagaactgtctatttaacccatagactcatgagcaataataaattattattgctttaaccagtgagatttgagtgaggcttgttatacagcattactgtgcaggtgtcaattgatatactctatattgcaatatcgattcttaaattgtctaaccataatcctatagaccattactaattccaagcttgttctttttatgaagagtgtcgctcaactctgatgtctttgttctgtttaatattttgatttacacatgaacacagttcccagcagctttcaaacctccagaagcccttaacatttctgattctgaaaaatatcttttcttgttttcagcattttttattgttattttttattcttttgtatgggaaggtactcagtttaccatcctgaattagtaattctttaaacatttttgcaattccagtaattagagatattactgcattaggcattgaagataccatggtctttgcatttcctgcttgcatatcgagtcctatgaactatttctggtgtctctgagtcacttcccagtgtggtcattggcttttactgagtctgattcaccgacctttactgagcctcactcaccaacctttggtcattcttggacatagaagcacaaattcaacagtgttgtttcccaaaatatgtaatatgcagggaaaattacttttcatgtaaaatagacgtgtccttttagtattaccagtagattattctaattatagactagtaacatccaacagacttatttgggtttagtgacagacctattactgtgttcgctcctcagttcaaatacagagtgtgtattttgcatcgtgtggctgcaagttttggggttctccatcatatacttagctatacaatgccagctactcttgtctggatattttcccaaatcctggatgattacaaacttctccttcactggtgaaattttttttttttttttttttttgagatggagttttgctcttgttgtccaggctggagtgcaatggcacaatcttggctcactgcaacctctgcctcccaagttcaagtgattctcctgcctcagccttctgagtagctgggattacaggaatgtgccaccatgcccggctaatttttttttttttttttagtagagacagggtttctccatgtttgtcaggctggtctccaactcccgacctcaggtgatccacctgctttggcatcccaaagtgctgggattacaggcatgagccacagtgcctggccaatttttttttttttaatgaagggtcaaacctgatattaagtctttcagacagtaagaagataactattcagggtctacaagatggccaattagaagcagctgtggtccatggcactcagggagaggaatgaaacggggtgagtgaatttagcactgtcaattgagatattcaggttctcacactgggactgtctaggcaaacaactcaacccacagagaacaaagaaaagcagggggtgtggggcatgatggcccaccaggagcagcacagagccaaaggaacccccacccccagccaaaggaagcagtgagtgattgtgtgaccctgcccaggaaacgactcttctcccacagatctttgcaacacatggatcaggagatcccctcacaagcccacaacaacagggccttggatccagtacacagagctgcatggagtcttagcagagcagctgctcaggcacacacagagacccaggagttttacacattccagcctcaggatccccagcaaggcaggaaatctgtccacatataaccctaggaagggagctgaatccagggagccaagcagcatcattctgcaggccccacttccatagcacctcacaagttaagacgcactggcttggaattccagatagccaatagcaacagcctagaatctgcctgagataagtatgaattcctggggaaagggggtggccaccatctctgcagtccagtagacttagctgtttaagcctgccagctttggagaatacaaatggtctggatgaggaaaggttccccataatcagcacagctgccttgccagatcatggccagactgcttctttaagcaggaccttgatccatcccttctcagtgggcaggacctccctgtggaggcttcagccattctagccagtgttctacattgagagctctgatctctccctaggatggagctcctggcagggaggggcagcctccatctctgcagttcagtcaactcagtccttctagcctgttggctttgcagaatcccaaaatggtctggacgagaaagcctcctcataatgcagcacatttgctctaccaaaaagcagacagactgcttctttaatcaggcccctgatcctgttcatcccaactggatgagacctcccaacagggtctccagccacctcctacaggtgtgttctggccagcaacaggtcagtaccccccagggatggagcttccagaggaagaagctggctgccatctttgctgtttcacagccttcactgatgatacctccagtatgggaaaaaccgaggcaactaaggtctggagcggacttccagcaaaccacagcagccctacaataaagtggcctgactagtaaaggaaaaacaaaaaacagaaaacaacaagaacagtatcaatgaaaaggaccccacaaaatccaaggtcaaaggtcagcaagctcaaagattgaaggtagataagcccacaaaaatgagaaagaatcaacacaaaaatgttgaaaacttaaaaagcaagagtgccttttctcctccaaatgactgtaacacctctccagcaatggcacagaattgagctgaggctgaaatggctgaattgacagaagtagggttcagaaggtggtaataatgaactttgctgagctaaagaagcatgttgtaatccaatgcaaagaagctaagaatcatgataaaacaatacaggagctgacagccagaataaccagtttacagaggaacatgatcaacctaatggagctgaaaaatacaacacaagaccttcacaatgcaattacaagtatcagtgggagaacagaccaagtggaagaaggaatctcagagtctgaacactatctctcttaaataagaggggcagacaagaatagagggaaaagaatgaacaacaccccccagaaatttgggattatgtaaagagactgaacccatgactgactggggtacctaaaagagataaggataatggagtcaaattggaaaacatacttcaggatatgatccagaagatctttcccaacctagcaagacacaccaacattcaaattcaggaaatgcagagaaccccagtaagatactccatgagaagataaaccccaagacacataatcatcggattctccaaagttgaaatgaaaaaaaaatgttaagggcagccagagagaatggccaggccacctacaaacggaagcccatcagactaacagcagacctgtccgtggaaaccttataaagtacagtggttggaagctattctttaacattcttaaagaaaagaatctccaacccagaatttcatatctgaccaaactagcttcgtaagtgaagaagaaatacgatccttttcagacagcaaacacttaggaatttgtaccacaggactgccttgcaagagctcctctaggaagcactaaatatggaaagaagaaaaccattaccagccctacaaagcacactgaaatacacagaccagcaacactatgaagcaaccacataaacaagtctgtgaaataaccaggtagcatagtaatgacaggatccaacttacccataacaatactaacttttaagtgtaaacagggtaaatgccacaattaaaagatatagaattgcaagctgagtaaagaaccaagactcactgatatgctgtctttaggagacacatctcacatgcaaagacaaacataggctcaaaataaacggatggaagaaattttaccaaccaaatggaaaacagaaaaaagcaggggttgcaatcttagtttctgacaaaacagactttaaaccaacaaagaacaaaaaagacaaagaagggcattatataacggtaaagggttccattcaacaggaagagctagctatcctaaatatatatgcacccaatacaggagcacccagattcataaagcaagttcttagagacctacaaagagagacctggactcccacacaaaaatagtgggagactttaacaccccactgacagtattagaaacatcactgagaccaaaaactaacaaatatattcaggacccaaattcagctctggattaagtggaactgatagatatccatagaattcttcacctgaaaacatcagaatatacactcttctcatcatcatatggctgttgctcaaatcgatcacatatttggaagtaaaacattcctcagcaaatgcaaaacaactgaaatcatgacagtctctcagatcacagttcaatcaaattagaactcaagatcaagaaattcacttaaaccacacaactacatggaaattgaacaacctgctcctgaatgactcttggataaataacaaaattaaggcagaaatcaagaagttatttgaaactaatgagaacaaagagacaatgtaccagaatctctgggacagataaatcagtgttaagagggaaatgtattgcactaaaggcccactacaaacctctgctcaaagaaatgagagaagatacaaacaaatgaagaaacattccatgctcatgggtaggaagaatcaatattgtgaaaatagccatactgtacaaagtaacttatagattcaatgctattcccattaaactaccattgacgttcttcacagaattaggaaaaaaaactattttaaaattcatatggaaccaaaaaagagcctgaatagaaatagacaagacaatcataagcaaaaggaacaaagctagaggaatcatgctaccagacttcaaactatactttaaggctacaataaccaaaacagaatggtgctggtacaagagcagacacatagaccaatggaacagaatagagaactcagaaataatacgacacacctacaaccatctgatcttcaacaaacctgacaaaacaagcaatggggaaaggacttcctatttactaaatggtgttgggagagttggctagccaaatgcagaaaattgaaactggactccttccttacaccatatacaaaaattaactcaagatggattaaagacttacatgtaaaacccgaaactatgaacaccctagaagaaaacgtaggcaatctcatttaggacataggcacaggcaaagatttcatgacgaacatgccaaaagcaattgcaacaaaagcaaaaattgacaaatgcaatctaattaaactaaagagattctgcacagcaaaataaactatcatcagagtaaacagacaccctgtagaataggagaaattttttttgcaatctatctatctgaaaaaggtctaatatccagagtctgcaaggaacttaaacttacaacaaaaaaacaaccagacaaccccattaaaaagtaggcaaaggacgtgaacagacacttatcaaaagaagacatacatgtggccaagaaacatttaaaaaatagctcaacatcactgatcattagagaaatgtaaatcaaaccacaatgagattccatctcatgacagccagaatggctattataagagtcaaaaaacaatggatgctggtaaggttgcagagaaaaaggaacacttttacactgttgtgggagtgtaaatgagttaaaccactgtggaagacagtgtggtgattcctcaaaggcctagaggcagaaataccacttgacctagcaattctattatggggtacatacccaaaggaatataaatcattctattataaagatacatgcatgtgtatgttcattgcagcactgttcaccatagcaaagacatggaatcaacctaaatgcccatcagtgatagactggataaagaaaatgtggtgcatacaacatggaattatatgttggcataaaaagaaatgagatcaggctgggcacggtggctcatgcctgtaatcccagcactttgggaggccgaggtaggcagatcacgaggtcaggagattgagaccatcctagctaacacagtgaaaccccatctctactaaaaagacaaaaaattagctgagcgtggtggcgggcacctgtagtcccagctactcgggaggctgaggcaggagaatggcatgaacccgggaggcgaagcttgcagtgagctgagatcgtgccactgcactccagcctggatgacagagcaagactccatctcaaaaaataaataaataaataaataaataaataaataaatagaaatgagatcatgtcctttgcagggaaatggatagagttggaagccattacactcagcaaactaatgggaacagaaacccaaacactgcatgttctcacttataagagggagctgaatggtaagaacacatggacacatcacagggaacaagacacactagggcctgtcagaagacggttagtgggagggagagcatgaggcaagaaaaggtaatgaatgctggcttgatacctgggtgatgggatgatctgtgcagcaaaccaccatagcacatgtttacctatgtaacaaacctgcacttcctgcacaggtgccctggaacttaaaataaaagtcgaagagctccctctccctctccctctccctctccctccccctccccctccccctccccctgcctctgcctctgcctctgcctctctgtctcccctttccacggtctccctctgatgcggagctgaggctggactgtactgccgccatctcggctcactgcaacctccctgcctgattctcctgcctcagcctgccgagtgcctgggattgcaggtgcgcgccaccacgcctgactggtttttgtattttttggtggagacggggtttcgctgtgttggccgggctggtctccagctcctgaccgcgagtgatctgcctgcctcggcctcccgaggtgccgggattgcagacggagtcttgctcactcagtgctcaatcttgcccaggctggagtgcagtggtgtgatctcggctagctacaacctccaacctcccagccgcctaccttggcctcccaaagtgccgagattgcagcctctgcccggccgccaccccgtctgggaagtgaggagcgtctctgcctggccgcccatcctctgggatgtgagaagcccctctgcccggccgcccagtctgggaagtgaggagtgcctcttcccggccgtcatcccgtctaggaagtgaggagcgtctctgcccggccgcccatcgtctgagatgtggggagcgcctctgccccgccgccccgtctgggatgtggggagcgcctctgcccggccacgaccccgtctgggaagtgaggagccctctgcccagccgccaccccgtctggaggtgtacccaacagctgattgagaacgggccatgatgacgatggaggttttgtcgaatagaaaagggggaaatgtagggaaaagaaagagagatcagattgttactgtgtctgtgtggaaagaagtagacatgggagactccattttgttctgcactaagaaaaattcttctgccttgggatgctgttaatctataaccttacccccaaccccctgctctctgaaacatgtcttgtgtccactaagggttaaatggattaagggcggtgcaaaatgtgctttgttaaactgatgcttgaaggcagcatgctccttaagagtcatcaccaactccctaatctcaagtacccagggacacaaaaaccgcggaaggccgcagggtcctctgcctaggaaaccagagacccttgttcacatgtttatctgctgaccttccctccactattgtcctatgaccctgccaaatccccctctccgagaaacacccaagaatgatcaataaatactataaaaaaaataaaaaataaaaaaaataaagttgaatcaaagaaaaaaaaagtcgaagaaaaaaaaagaagataaccatttgaattgcctcatcaggtggcttgttatgggagaatgtatatttccaagactcttgaaattaaagagagtgagctatcataaacagtgagctcctagacagaaataatttagagtatgtgatagtaagcacacctgtcaaggctctctcctttgaagaaaatgtaatgaggaggactctgaaagaaattagagcatgtacacacaaagattcaaaatcaatcaacattattattacaaaagctgagagcagaattaaaagaatgcctgtgcttggaatacttgttatggagaattttaatttgctaagaaaatggatgagacactacagtattttgaagtgatacttccttctgatcatcagaacaggagcaaaggaagaatatttaaaattgaaagcttttatataattcttactgtgttttgggcatttcaagtgggttcattttccaagtagaaaatattcagcatctacttagaatgccttattttatggaagagtaaactgaagtagagagaagatacataattttcttcatgtcacatggctagtaaatggaggaaagagggattcaaacacaagaatttggggactggattccttttaaccatttataaactattataaccaaaattaaaaatataggttcattaaaatggaagaggaacaagacttccttaggaatagttctaacttcttagaagacatatttctcatatgaaagaaagaggaggttctcggccgggtgtggtggctcacacctgtaatctcagcactctgggaatttgaggcaggcggatcacttgagctcaggagtttgagacaagcctcggcaacatagtgagatcccatcactactaaaaataaaaaaaaattatctggggattggtggtgcatgcctgtggtcccagctactcgggaggctgaggtgggaaaatcacttgagcctagggggtaggggttgcagtgagccaagagcatgctactgtattccagcctaggtgacagagtgagacctcacccccaattaaaaaaaaaaagaaagaaaagaaaagaaagaaagaagaggctctcatatccaggaaagatcaattttagagggaagaggaaatgcactcagggtcaactgctctcaaggagttattagaagagatttattttggttgttactaaggcaggcaagataactggatgtaaagaatcttcatggaggaaaaacaaagatacaggatctcagaggggagactagataaactttacagaggaagacaggatttggggatttgttaaggaatgacttaaaatcaacactatataaagggttatatgcaatttggacatttttgagaagagatgccctgagacatcaattgaagactctcaaattatttgatgttcagctctagcctgtgcttgaaaggagcctgcttaattatttttaaaattatgagtcttaagaaagtgtaagaaagatggaacatattaaaggaaaagcaggcaaacaaaaaatgagaataccttttagatacaattgctcaaccaaggaaattaaagatattcaatatttatcttaatagtgcttgctttagaggatccagacattgttaattgcacatctctcaatagagaagaccacagagatcaaatctagaatattttgaaaagactagtgacaagtacaaacataaaatttaagaaggaatttaattctagtgaatattgctaatactacatgtgcttgagaaagaacaggacaaatttacaaagcctttcaaacttctagaaattcagcttaagctagaccaggcccagtggctcacgcttgtaatcccagcactttgggaggccgaggcgggtggattacctgaggtcaggagtgagagaccagcctggctaacatagtgaaacctcgtctctatgaaaaatacagaaattagcttggcatggtggcacaagcctgtaatcccagctacatgggaggctgaggcaggggaatcacttgaacccaggaggtataagttgcattgagccgagaccacgccactgcactccagcctaggcaacaaaagcaaaattccatctcaaaaagaaaaaaaaaaaaagtagtgagccaactctttattcagtaggggatcctgtccgctaaggaaaaggtaatggaagggcatattcgattcaggagaatgctagctagcccaataagctgcaaagctcagccccttctttaccagaatcaaagctcacatttccacttcagttgatctgacatgagtatttttctctcaggtgttttgaatcttaggtcagaaagagtggttacccctgcgcatgaccactgtgccaatgtaacacagcatatattactttgggtcttgacaaagggctcatttttagtgactgagtccttctggccaccaggagacacttcagtgccacaaccactcactgacactttagagttgctaagaggactgtcaggccatgggaaactaagaagaagctcaggcttggtacctgaatcatgagtcctacctgttgagcactgaaaaagcactggaaagagaagggaggacccaaaaacttctaaacctgtgcgaatgggctaagaccaatagtgaggttgggattttaggcaagtttgggatggttgtcagacaaagaagccactgatataccactagtacaatgcagttcgaattacaataaaaagttatagggggtttttttgggtcagaaagagaagaagtaaaagagcacacatgattcctatctccttttatcctccaaactaactctcactaacccacagaaatgttttcataggtggcacaaaggtaggctgcaacaattgtggccaatattatggtagagaaggaccctgccctgtaatgctcaacatattaatgttacgtgagagtgggacagggtcatctctgtgacagtatagtcacagaagcctcttcctgctcaaataagtggccttcattaaaagaaacacagaagaatcttgtttcataagctaatgccaatcactgagacagcaacggtttcaggaacatgagggaagctgttggaatgggctttcctttaaacctagcctggttccatcatgctgagtggtgggggctttaagtcagggcctgagaaggacagcctaactgtggtataagtcagagggctcctcattcctcataagccgacaaatacattaatatcatcagaaaaattaccagggcctgtggtgtcccaaattctgatttcattttccattgaagatcagagcacagaggaaggagatacctcactcatgtgctcttcttgttatatgctcacagtttctttgtttcaatgactctgtaccctggaagaggttagacctggatatgctaaaaaaaaatttttttaatccctatcctagaatattgtggccttgaatcaaagtgttttctatgtttgtgttttcatcttccttcctaagccctatatctaggttttgccttctccatccacaaatctcaggatgctatggagtctgaagacacctgattgcagaaagcacaagaccccccaccagcgcgcgcacatacacaaacaaatacaggaccagaaaggagtggttactgctgattctctaacattacaaaaatatcacggttgtaacttctcaccctgccagtcatatgtttctctgtcacttgacatactcccctctttggggtgttggaggaaaaaatctctgtgccaacagcagagacatggaactagtgtgtcacatccactctatgaacagaattcttactactatttataccctaaaaagcaggccattttctagagtttcaccccctcaccagaaagaatttatttgtgagtattggttgacttactataacaagagactcaagtgttaatcattaaaggaacctgttagtgctttcttagaagtaagaggaagatcacatttaactggagagtgccttattgtggttttcaaggaaggtcaaagctcttacttatcactgctcaatcttcacccgatgcccaaagaattaacataattttgaaccttaccctggagaagcgaaatgggaccttgtcctccagaaatgcagaagacactgtgctgtgggctgggggagtcacggagcacgagagtatccatctccagccctcactggaaataaaatctgcacagttctatctctttccagggcagccaccttgttctctgcatgaggagcatggaggtccagatgcttccaggagggatctggggcaaagctctaactaagcaacacattattttgattttgtgtgtctgggatataaggatggccggtaaggggaacaataaagttcttgagatttcacaagtaatttattgatgtccagaatttgaggtgctgatggtacacctaagtggcaatatgcaccaggcagatcaatatgtgactcgtcagagaaagcagaatgggtgatgtgatgtgcaatgccacagaagcactgcagccaggagaggtgacagctaatggggatgtttggagtctttgagtgaaccaaacacatcccagagtaattgtaatttatttcagtcaatcttctgtacagacttagcattcacctttggaggaaggtcctttgagcagggacagagatggtgatgtcactgacagtcccccttttactctgggtgagaggtctagaatcctcagctcctgtattcgtgcccacaagggcctcatctaggtgaaggctccacctgccccaccctgccatggccaccaggctcctctgctgtgtggttctttgtctcctgggagaaggtgagtccccacaaataaagcacctgcatttttggatattgccagttatgattccaattatgtttcttattctgtccccaaattctatctcttttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtttggtcacagcgctgcagaatcacctgctccctgtgcagaaaccctggtgcttcctcttctcctccagtacccagcagctctcagcagcctttcttgctcctcccctagcacaggaagtacataggtttcgtgttccacatgtcctaggcaaggcaagaacaggtcataaggacacatcacgttaggaaacttttggtaggaagtcagtgggtgtgatggttcctgggattccacacatacttctcacaagggtgcctgagtccaagtttgagggcgagtgtcacagactggagctttcaagtgattgagtgagcttaaaactgtgcagccattgcacatggatgcttatctcctttgctgctttccgttatggcttctttgccatttcttttctcttctaccttaaaactttcaacatctttgatgacttccaacatcaatattggcttcccagttttttcacttgctcacttcaaatgatcatttccttcaccttgtgtcagatattcatttccactttctttttctagattccaatgacaaattatttgaattacccccaaatagtttcctcaagcatcccattgtctcatgcgggcttctcttttcatctctggtactacttctgcagcaattcttcaacccatcaggaccactaattgacttctcctgcaaatattgcaccatatatcatctcctcatgtactatattccttatctgacttagactatgtgttccaaggtgattgtgaaattttgcctatgtcttcagctcttttctttttctgtttcttacctggaaaataaaatggggcctactctgtgcccctttcaatgacacagagaacataaaatgtcccttacccttgtcaagcagtattataacgatacagtgtgtcttgaggtctgtaagtccctctatgcatataaaattatatacttttcttctattaaaataatttgttaccttttaatgagttcatcagtttcatctttcaattatagttatacttttgacaattatagaagtactaaaaaaagttatgcacccagaatgtatgattctatcacttttatgtgtgtgcgcacttcacttcatacgtacaaaaaagttaaaagaatgccgaataggcatatttatccattctcttgtaggaatgataaagatgaacttccaaggggaaaatattttcaaaataatccatggcacataaaattatttaagaaaaaataaatcaataaatatccctgttaagtttatatatagttttatatgcttgggtaaggaagaaaaaaagttgtgatatattttgctggttatttggagagataaaatatagaaagagcagaaagaacatgattagctttgtctttgtttaaaatttttgctttttaaatttgatacactatttaccatcaaaatttaaaacaacaccactgctataaaacaatatacagacaaactaaaaagaaaaaggaatttactatgtaaaaaaaaaaaaaaaagcgagagcttataggcagagtattaaggggaatttaaaattataaagacctgtaagttttcagagaggtataggcctcacagctggagctgggattttaatgtccatatgaaagagatgacagaaaacagccagaattacattgcttgccttaatcctggagcttcaaaatgctcccaggctttataaagtaaaagtattacaccccaaagacccagaaacataattggaaactggatgtttggtcaggcctttgggtgatagataaaaaggaaaagttaggagagaaaaattgaatcttcagactgtgtctcacatgtgtttggaatgaaatatactctgcatggaatgtacaccatatacccaaaaactgacaaaaaggtccataaccattaaaacccttggagaccctggcattaagagattcaatacggttctggagtaaacttctgcttccaaccaagatagattaacgggaattagatttaacttcttgcttgaaacagctaacaccccaacccccaccctgtccccctgcacacacacattcacacaacatgtggaataacggttgtcaagacattggaagtaggcaacagaagacagtgatctctgagagatggaaacaaccaagctgagaactatgactgtcttaatacctggagggagtttccaggccctgggccagaaagaggaatccaagcagagctgggtgatctcactgagctgagtcagagttggaaatacaagatcaaagcagctagatttcacatgacaggccattgaaaaggcgattgctgcacagagagaatcctggagaccttcctagggtctcccttaacccttcagctgtgctgtaagcagtacatgtgtgaggaaactccctaaggttggagaaagagccactcagcaagattagaggaaacaatgcctggagctcacaaagggctgagagtaatatatacatatattactctcatatatatatgtatatgtatatttttgcattgagaatgggaaacttaataattcatgggtcaatcagtagaggtttcagatgacttatgcctcagtataaaagcaaaataagcccttcactaaataagccacatttggctcctggcctatgtgggtgagacttcaaaatatcaaactgtttccgagtaacttaagtctcagagcaaaactaaagaatatttctaatgtacaagaatacctgttcggagatatcagtatgaatttattgtttttaaacgtatagatacaatggtaaagaaatgaatacatacctgtgtgaataatgggttggtatatatacatgtatttcatacttctgtccacttagaagaccactagtgcacagatgtttgttgccaaatattattctccaattaaaaaaaaatgaaaggtggttctaggaccctgaggtaaaaaatacaagaatgttgtaatgaggttttccaaaaaaaaaaaaaaaaaaaaaggatgggacatatctcaaaaggacagaggaatcaatctgaaagagcttccccaatgactaaggctggaacaatttgtaaaagaaaattcacaagttcacactgagaatgaaacgattaaataaataaataaataataaaaaatgtgagaaaggacaatctcttactgaagaattccaaattgcatatgtagaagaaacagagggaaatagaaaagtcactgtgacaacaccactgtgagtaactgccacacataaaacccaatagtgagtgctaaaattagtgggtgtagctaattttaattactaattaataactaataactttaataactaattaagaagaaatggatcatttgtacagtcacaaagtgtcatccccaaaatattaattaatatggtggttttaacatatgcccacacattcttttatactcatccctctagattcccctctcctggattcagtggcctgcctctaatgaacagacatgggaaatagaaaaatggtaaccgagtgatccaaagtaaataaactgacccataataagtcttgttaacctcatgtgcattctcttatgatgcaatgttgtgatgttatcatgtgactacatatctgtaatattcctcccccaaatctataattcctgtctaataatgagaaagcatcaaacaaatcccaaactgaaagagattctacaaaacacctgaccagtaatcttcaaatgtcaatatcgttaaaaacaaggaaagagctgtcacaaattgaaggacactaagaagatatgacacttaaatgcagtatgggatcctggattaggtgctagggcaggaaaaggtcattattagaaaaactggggaaatctgagtacagtctagcttagttgtgccaatgtcaaattcttagtttgtgtgatgttagcactagtgggtgttggatgaaggatataaagtcacttggtagtattgttatagctacaggacatcaattctccagctttgggtcacctgagtccctatcaagccaatttgtgaagctgctgttagttgtccttactccccagtcttggagctctcagttagacctagaatcaacctcttcttcctcttgacctctgcttcactgcatcctaaacgtggtgaggtggaggggtggtgagggaggctgagcagaagcccatcattcagaagcccatcactagagcttctctgatgattctctgagacaggggctccctctgtagtctcctttgtgcacaatcccaagcacgctgggccacacagactccaccaaagctagttttgtgaggaggcaaatattgaggctccattgtgaagagaatgtccatgtcagatttaagtacaaaagattaaagttgatgcattactattgcaggaaaatgatacctgtgagaatttccaaaagccagattttgtattgtgtggctggctgagtaatacccctccccacaaagacattcacatcctaatccctgggatctgcctctgttaccttagatggtgagagtagactttacagatgtgatgaagttaaggatctggagataaggagattattttggattagtctggtggccctcaatgcaattacatgtgtccttataagagatagccagggggagatcagacacaaatggagaagagaaggcaatgtgaccacaggagaagagattagagtgaggtgaccacaagccaaggagtgaggcagccactagaaacagaggcaaggaacgaatcctctcctatagcctccagggggaatacggtcctgatgacacctggattttggtccattgatactgattttggacttttccagaactgtgagaataaatctctgtcattgtaaaccagcaactttgtggtaatttttatagcagccactcaaaattaacacactccaatatgtccagttaacctgagactaggccaagaaactcatgttcttataatattttctgcaaaccttgctgtcatgtttttatctgacacccatctcaaactataatgaaagaaaataattttgagacttcaatgtccccctgtctggggtgtgccttccatagttcattggaaaagtctagtctcctttcaagattttattccagcagtacctcctcttgaaagaattttaggcattgttttctgttctcagtgcacatactaaaaagaaaaagacaaagactcatgtctacttgatgtttacatttttgcggggagggagagacagagataaacaaataagtaaggcatatagtgtattagcaggtgatacctgcaatgcagaaaaagaaaaggcagactaaggtgagggagaccaggactgtcagagtaaggagcgttgaaatgacaatacattgttcagagtagggcccaatgaggaagtgacctttgagcaatgatttcaaggagatgaaggaaagagacatgtaggtatctgggggaaaagaattccaggcagagggaggagccagtacaaataccctaaaaaaatattttaggaccaatgaggaggcccatatgactgaaaaattaaggaagggagtggtagactttatttccaagcggtaatggggcaggatggatcatttaagaccttgatggccttaagtgctttgttgttttgttttcttattccaaataaaactgggagctagtagatgatttggagatgagtgacatgatctagcatgttctagagggctgagtttgagagctagttcagaagtaggtgaaagcagggagatcagttaggaatctattgcagtaatccaggaaaaagatgatggtggccttgtcctgagggttagcaaagaaggtgatgaaaaaatggatggattctgagtgtattttcatgatagagccagttgaatttcctaatggattggctatagggtgggatagaaaaagaggatttgggaaccactctaaggttttcagctggaaggctgttggtggagtaaagttgaggataatctttcatgtttagagcatgctgtttgagagtggtggggggaaaatgttgattggagtgcattagagagataatgggaaaagagaatttggaggtaagtattgatcattagcaatagcaacaatagctaccgtagattaaaatgccccacagtctatggggatgtgatacatgagggaagacagggccagatgggatgaggtaggatccagacatcagactcaggagctacgagtggtatatataaggttaacacctagtcaaatgcataaacaggttgattttaattgatgtcagtttttctccattgccccctctagaggcaatcttcttcagagaaccctggctaggtcttctatgtttcatgtccgtagagggagctcctgagactgtggacattggctaatatgctgatgtcactggaggccacatcttacagggccaagagacagatttgctttcctttttctcatacttgtaagctccttcatctggaaatgtgatttacctgggtcctgccatggtttccaggcttctcagtttagtgtccctttgtctcctgggagcaagtgagtcttcaggtacttaaatatctgtgctgtaccctatcccagtctattcatgtcatgtattctgtttttgtctcttcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagccaagacacagtgcttcacagtcgtgcccttgctgtgcaaaaccatagccttctcctctcaactcacagctgcccaaaaggaaggctttccctgtgccttctcccccaaggaggggagataaagaaccagaattaactcatgaaatacaagagtattccaagaagatttgggtgaaaatacttgtggtttgggggatctctgaagttttttaaacagaactcaaactatgtgtttctcatatttatttttattttttaaagtgtatgttgcctggttataaagcagacttcttgcctatcttgctgctctgaaaggtttgtgactctgactgtgaggccacatctttatatcccttcttatagtaagagaaacaagtctttctgatgaaaataaaaatagtgaataaaaatgcatttactactggcttttaggatgctcaatgatgatgctagcaatggtggtagtggtgacgttggtaatggtggtgatgagtttaggttgcttttgtctagcatttataaatttccaaccactttaaaacaatctcattttagagtggaatagctaagtccattatcagaggttaatgctaattttctgttcacatagggtctgagtttttaatgtaaaaaatatagttagcactataaatagatatctgtcagccgatacagaacattttttaagatcacttccagttgctgcaataggaatatgtattcctattttttttcttttttctttttctttttttgagacgaagtcttgctctgtcgcccaggctggagtgcagtggcaaaatctcagctcactgcaacttctgcctcctgggtttaagcgattctcctgcctcagcctaccaagtagctgggattacaggtgcctgccaccatgcctggctatttgttgtatttttagtagagacgggatttcaccatgttggccaggctggtcttgaactcctgacctcaagtgatctgcctgcctcagcctcccaaagtgctgggtttacaggtgtgagctactgtgcccggcctttttttctttttgagacagggtttcattctgtcaccccggctggagtgccatggcagtgtgatcacggctcactacagcctcgacttcctgggctcaagcagtcctcctgcctcaggctccctagtagatgggactataggtgtgcatgaccacacccagctaatttttgcattttttgtagggacaggtctcactatgttgcccaggctggtcctaaacttcttggctcaagtgatcttcctgccttggcctcccaaaatgctgggattataggcataagacaccatgcctggcctggaatatgtaatttttaatgagacctaatggtataatacattctacctggttcaactgccttcttttaatatctggattccaatattctgctcatgtttcagccatgtttttgcaaacagtcctgaaattcactctaataataagtttcattttcccagtctgattgttatttagcacctcaaattattattgaactcatcctaatcctgattaggcaaatggatagtgagaaaatattacaagtgggcttggattttaattttttcaaacaatttaaaacccattttccttttctaatgatcaagatccaatttttagataatcagtactctctctttctatgtggacatgtaatatgaataggtatattgtttctgtcacaggcatcgcaaactcatatcttgcttgaaacttgtcgatgaactcctttagtatgacaagaacaaagagaaatagatttttaaagcatagccacatattggacatgagtttttcttcaaaatttcagctgcagaaccctaactggtgcctttccttttattgtgttatgtaatctaaggtcataataagtaactaaattattgatttatttttccactctgtaatctctccattatatttaaaaatagcagctatgaagcaaaacaagttcctcgttgggtacattgcctcaactccaaaatctaacaagcagaagtttaattcagtgctttgccatttcatactatagacaccgaatgtcctatcctataaggggcacacagtggttctctttatagttctgttagctcaagtggtatctttaggtacaatttttagaatttttttatttgttaatctttcttaaggtatgattgacagaaaaaaattgtaggtatttaaggtatacaaggcgatgttttgatatacatatacattgcaaaatgattaccacactcaagttaattaacatatccatcacctcacaaagttacctttgtatgtatatgtatggtgagaatgatctactctcagaaaatttcgagtgtacaataatcattaactatagtcaccatgctgtccattaggtctccagaactttcgagcacactccaaaacatcaacttttattctgattaagcctcaaatatgtcttcttgttgcaaatattagctatttttagattagctataaataatgaaaaatgctagcataaaagatggaaagaataaatgcagataagggctctaaggtctttacactttccaggaagtgataaaagctgcaatttaaattatacatgaagaagtcaaggatggcaactcctataaacagctgatacttcaaacctggaatgtctagtgctaagcagcccggacccctgcacccagcacacctctctttggcatgataggaggatgagggatccaggtcttctcctcccatgctgcccttggcctttatgttttgcctttcattagtaaggcttctcccttaattatcaccctatgacaggaaattcatcctaagcctggacacgtgagagatggtaactctgaagcagccccctgcggatgacaccaaatgaggccacacccagaacaaattgcaagaaataacaaggtatttcttacagaatccctaagagaacatgtctgtctgcatttaagtgtctacagtcataaatgcacagcatatgattggatcagatggaactgaaagactttcagtgcttcatggtgcccataactctcattgtcctgaagtggtgttggcagtggactcagcagggtgccgtgagatggtgaggctacacacatacgatcgtgaccaagctggctacacagatgggccaaactcaccctgtgatggtagacagagcttaccaatgggttccatgaatggacaatgggcatgctgctgtaataatcccttcgaccatgatggaagtcaggcaagacccaggccatgggaacattgaaaacagtcacctctagcctcaagtatttcctactgtttgccacactgtgcctacaaatatcatttatgatacagcttaaaattttcatgtttgtgaaaattattatcagccttatccaatctgatattttgaatgaaatcacattaaaaccatatattaatttaagaactggcatcttcataatagtgagtcttctacagtttcctagaccactaaaaaatcatggattgctatctcagacttgaaatgggtgatccttattcttctctcagtcagaacagtgaaaggtacagattcatggcagctagtccagcttctaaaagtcaacttctaattgtctactttaggacaaaaaagaaataatatccttaggaaggccaccatggaattcattctatctgaacaatccttacataatatcatttcttataatatgtcctcaacatcgtgctctgcatatatttctccaccatctctaaaaatcctcttagcccaggcctcctcaaactttaatgtgcatgtaaattatgaccttgttaaaatgcagattctaatccaatcagtcagggttggagctaaggttccctgtattttgaacaagagtccgtccaagtgatgccaaagctgccagtccatggaccacaatgagcagccaagctctagatgacacctacaataattacaggtgtaaggcccctcttctcaagtatcattttgcacagttcctggactaggtcagatacagaccctacttaccacatgtatctctgtattccaagtattacgtaatcatcagttttcctaaatctaggcaccaatattttaacatatattttcatggtataaatagaaattaattttctatagtaaatacactaatacctaatcacattcatgcatctttaatgtgagtagcaaaaagccaaggcactatcttaatggttattgagtgagactttagcaaatactatctttatggagaaacctctgggctgctttttaggatgtgagaaaagtgaggtaaagtgaggagaactggatgaacacgggacagagacagggacaggggcaaatatggggacacctgtctcaaggaagcagcaaatgatatagaaaataaatatctgttccatccctgttccagacaagcccatgtacctgccaagtaggaagctgtgtatcacattgcaacaaggaatgaccccggccctggtaaagtcaacagcaacagtcatcacaggccaatctgcctatcagggactggagactctctaaactcccacctctcaacccaggaatcagagcctgagacagacagatgcttcattcctgtatggggtggtattcctgccatgggtcctgggcttctccactggatggccctttgtctccttggaacaggtgagtactgggcagaaaggaaatctttgagcaaagctatcttgtcctcagtctgcacctttcattcacagcagtaacactgttctccttaactctgactccaaatttgtcttctttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagcagagacacagagctgcagtgcttcctgctctctgttcataaacctcattgtttcccagatccaggtgctttctctaggacttctccctcaccacctcttacaacaataggaagtgggttggtggctgtcaatatctgtagacagaagttgagcacaaaccaataaaaaccattgacagttatgccaagagtggaaaagtggttacacatgcctggcattcagttggtggtattttcccaggatcacatttagaacccatgctgtccttttcagaagacaaataagaactttttctttctttttttcattgttttaatctaagtcagaggcttagaaatataagaggtgatatgtgaagaattatggacacccaatgtctatgaagtccagtctctggcattcgatgaactcttataggatttaatcctcctggagaatccacatgtttttagcctagacctggagcaactacctcattaatgggagaatgaaagcacaagtatcccaagataaaaatttctcagaggtaaaaccacattggagagaaaaaaagagaagaccatacattaatctgctcatatctggagttggaggtactattgagatgagcaaatggaaaccataaatacataaagaaatgatattgaaaatagagtacatttggagatgaagatcatggagccatctgtatagaagagagtaataatgtcattaaggtgcataagagtgccagcaaatgtcaataagaaaaactacaggagggaagaagatgggagatcctgctccccttaacaaagataaataaaatgctgagtgagaaatattgcaacctcataaattgtcacatggaagtatgtatttataaattaccattataattaacatccctcaatgagaacgatattctgagaaaaaaaagcagaaaatatagttatatggctatctaaaaatgtaaaattttgcacattaaattaagataatctaggaaaaatatgacaagacctattacaaaagagcttttacaaattgtttgctttaatgatattaataacataatgatagctaacatttactaagcacatattacatgctagaccttaagtcttcttcacatatatttatagttcatgttagttttataacaacctcagaaagttaatactatagtaacctcactcatttatccatgaggaaactgaggcacagacaagtaactagccctttatcacgtatctcgtttgtggtggagccagtatcaaaatgtagacaatttactgctggagctcattctgtcttcggagtttacatggattctaagtcagaccttcagataggaaggtaaatggttataagccagaagatttccacactctcaccaacattgcactggcttttctttgggtcttggccagagggtgagcccttgtgactatgcttcactggttgactaggtttgagttgcaccgaggaccaacatagagaaagaaggtctttgggataaacctgggaggatgaagggtaaaaaatgcagaacttaaatcttgatcccaagggatcatttaaagatgaatgagtctcccttagaggatgagaaattaaacataaactctttaacttgcagagatgctgaagtgttttcctcaagtagtaaactttgaatcatggttatatgcatgggagggagcctatggggatggaacatggatgaaaaagtgacaggatgttcagggggcaggtgcgggcagaaaatcagctgcctccaagagtggtgagagaagctgtagagcatcctttatccagactggcacaacatgcagtccagaaggctgtgagatacgaggaaagggtcaccataaactgcaacctgactatgtcaaaaatgacacttggaatccgagagtgggtacgtgtggtggtatcacagatatacacccaccccatccccgcccaactgggagataagagacttacaggtttagcactttcaccactgggactagaaccctggatttagctagaggctggcttagaccttttcatggttcttctgtatgaaccacacaatttagaaccatactatttagagatgatcaatttatacgacctgcataaagcctgtctttccagaagaagctcaggttcaaaaaaaaaattgattcctctcttgtccttctcaatcttccctccttccttctttcctttcttcctgcctgcctgccttcctcattaaggatagacatgaactagtcacctgtatactctctgaggtatgctgttagtgctgacaacacattagttcaacctagaaaaactaaccctgttttattttatcttatctgagagtctgagacccctctttgatccttaaaaacttgccaatttcttgccaagcaaatatgtgcagggttttagagagccgtaggtaacagagacaaaatagaaacaacacacagaatttggagcaaagcctttagatctctaaagcttgaggccccactgctgctctaagcctgcctatggcaccaggttcctctgctatgagtccctctgcctcctgagggcagtgagtcctgggcgtagatagtctgtctgccttgggcactcacactgtagtctgtttccacaccttcctctggtagtccaatattcacccccattttcctctctagcccctgctcctacactctagtccacagactctgtggatatcctaatcacagagacagaaacagaggtgacactcagatgtgagtgatgaaacttacaatgctgtaaacaagactcaggacttagactgcctactgatgttcattcttgtgccatttgttcagcaaatatgtatttaggaactcctgtataacagaccttgtttccggttctggaaataaggtaataaacaaaccagagagacttgttttaaactcctggaatttataaaccaaagagatgtatgtgatgagaacagtacgactctggataagaaggaacctgttaccttaacactggccagtgcaaacccagtctggcagacatctgtgatcctctagacttgtaaggaatcctatagctgtatagctctttgcatttaagggcaaaactagacaagacagaacctcactctcatgaatccatgccctaagaaagagaagaaacttccctcataggaacattggtgcagtctcgcagttttcttatcaagtaggaaaattagaactgctaaaactttgtgccagaatttaagacaaataaattgcctggatcatgcattatttacaattatatttacaattatatacagatattttccctaatataaatctgttgatgaaccacttatgtggcatataaataggacttattaaaagttagatgcggtgctttagaagatatattaaaattattagagtctgacttaaatttttaatagtaatacaaaatataaagtaccacagccttgttcagaagaaacaggatttctgaaatccaccagaatagctttctaaaagccagtatcttatggcctttagtgggctgaaatacttataatgatggattggaaaaatggatgtttgagtgcataaggttcacgagtataagaaacaattggtacctcctaactatagattgtcagtttcagaggatgagaatgaatgtgccctcatcctcattttaattttgaaagacaatgcagatatccctactatagaatcattttttacatcaccacctatagagattaacaacatagatgtttccagctccctaagaggccaagaagtattaacccaaggtcagattcaggtaattgatcgtgactcacgaattttcagagatccacaatggttgtttttaaattttcagcagttatgtctttttctctggggagagggtattcaaagctcctcatgaggccattctggactacttttcccctcctgccccctgcccataaaacagtttacagaaataggtgtccagaccgtgggctgtagttcaccaactcctgctctagcctaattttgtctcattactagagcatggccattctgtggatgccagtgaagcctttctggggtttctctccaatgccttttaaagctttttcctacacagacacagtttactgtttagccaaaaaattaagataattcctccagacatctggagttcttgtgcagcttcctcctctctggtggtctttccttaaaaattctagctgcctcagcccccgctgattttgtaacctgtttccgcaactcaaaatttgccatgctctgttgctctcttccccattgtgtatgtgcagaaattgcccccatgttttggtgttttggcagaatcccagtcctgtgctgtctgctttccagtggctgaatacaattgtttcacatattctcttaatttgtgttacttgtatagagcaggatgctaaaggcaattggattctacaaagtgatcacgtcacagagaagccgccgacagaggtggagagagccacacagatagccagctgcctgtgctgcctgctcttcccctaattctgccatgagcccaatattcacctgcatcacaatcctttgtctgctggctgcaggtaagtccctgttctgcagttgtcagctccctgctctaagcctttcatccatgtcatcgaactccctcatgggctcagtctccaactcctgtctgctttctttacaggttctcctggtgaagaagtcgcccagactccaaaacatcttgtcagaggggaaggacagaaagcaaaattatattgtgccccaataaaaggacacagttaggttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagccaatccacaatgttaaatattagctaatcttaggacacagactcatcacggactcagctcaggaagcaggtggtatactaggttggaaggaaataacagaaactagagctagcttaagccaaaggggaatgtattataaggctaaatgtatgtcccatagaaccacaaagcaagaacacaggaacttcccagaaataaactgcaatgaaaccttagaaccggtggtcgcgcctgtaatcccagagctttgggaggccgaggcgggaggatcacaaagtcaggagatcaagaccatcctgactaacacggtgaaaccctgtctctactaaaaaaaaaaaaaaaaaaatagccgggcctagtggtgggcgcctgtagtcccagctactcgctactcgggaggctgaggcaggagaatggcgtgaaccgggaggcggagcttgcagtgagccgagatcgtgccactgcactccagcctggacgacagaacgagactccatctcaaaaaaacaaaaaacaaaaaaaaaccttagaaccatggcatggctgattgacaactcattttttatataccttgtcggcctcattattctcttttattataagttgtcttttctgtttcttaggtcttacagtgattagaaaattgcagatttaggtgttagccctccagtcaattgagaccaacgtgactttctctcatgctagattacaaatccagggtgcagggggaaaaaatgtgatcctgctttactcaagaatgggctcgtggaaatccaagggaattgaattattttgaacaagatagtatctgggagtctgtccctctgaccttgtggaccaaggatttcaaggggtggaatccagtcagaacatccaataggcacccatcacaagtgagaagttggggataatacattttctggaatatagagaccttgggaaaagagaagagtttggagaggggatcaaaaccttattatttagaacaatatcagaccacgtaaagagtctggttaatctctctttaagaaattaaaccggccaggtgtggtggctcacggctataatcccagcactttggaaggccaaaagcaagcagatcacctgaggttgggagttcaagatcagcctgaccaacatgaagaaaccccatccctactaaaaatacaaaattagccaggtgtggtggcacatgcctgtaatcccagctacttaggaggctgaggctgaagaattgcttgaacctgggagggggaggttgtggtgagccgagagcgcaccactgcactctagcctgggcaacaagagcgaaactctgtctcaaaacaataaataaataaataaaatagaaggaataaaaagaaattaaacctagataacacaaaaagcatgttcattttaagtgtgacaacttcagatcctacaaattcactaattggcctctatggcactgaaggagaacagattaatgtactcttggtgtaaaacatattaatgcacagagaattaaaagatcttcaggtatatgattcaaattgtaatgaggggcaatgtactcaacatcaatattcctaatgaggcattatggtatcaactgtacctaggcaggagactacacttatgttgagcagttatagaattcaaaataactctgttaaaatttgataatccattctgttcacagatctggtcaccacctagcattcgctttgagagaagttcctttattctctccagttacatctgctcttatttcagtataagttgaacccagttgtcttacttccagaagtccaaagttacttcttttcttgggaaaaaaatttactgtgactcctggaaacagaagttctcactttatcatttttctgatctatttaatattataccttctcattttaagttccttttcccgctctccagaagtgagtgttccttagcgttctgttctcggtccccctcaagcccagtcttgctgttggtggtctacatctttgcttttgtcacagggaagtcactcctctagatgctatcttcagctttttcttgaaatatttccattctaccaaaactgttctcctaaagattaaaattacgtatttcccagaccaaaagacgcatgtgtgtttctttgcctgcttgatctctttgaagctcttgacaatactgaccatgccctaagtcctgagcattaatttttgctcagtttcatttacatcattttcaactagtttctcattttctctctattctttttgttttcaatgcagctcccagaaactaaatctatccatttaatattctttttcccaggaaaattcttctcattctatttaaagtgtaatattctagtttaatgggaaagttttttgttgttgttgtttagccttttaaaaatctctactgaaaaaattttggatatgaaaattagccaggcatggtggcgggagcctgtaatcccagctactcaggaggctgaggcaggagaatcgcttgaaacttggaggcggaggttgcagtgagctgagactgcaccactgtgctccagcctgggcaatggagagagactccatctcaaaaaaaaaaaaaaaaagaaaagaaaagaaaaaattgtgaaatgtggtctgagacaacttttctcagtgtcacctgaggcatgggttaaacaggtatattctaggacaggttcagaatttcagagtcgaaatttcttgttggtggactttaggaatacgtatcattgctcctgagtatttctgttagtgctgaagttctgccccaaggacttcataagattaataacatcgcaaatcttctgtagtgctttaaaattttgttcttcatttttttattctcactttcttctctttccttttccacttcctcttatgttttccttaatcttcaactttcctaagcacctgcaagtgggattggagccttgtttaacatcgtccatgtagcaaaataaggatgaggccaaatatttgaaccaaggatccccatctcctatggaaggtgccctgaggttgtgggtgttgctggggacatgatgtcatggccagatcctacatcatgcggccaagggaacccagaactttcactgctctttgctactgcacatcagaacccatcgctgggagtgtcttgcactgcctgacctcaccatggatatctggctcctctgctgggtgaccctgtgtctcttggcggcaggtgggtccaggtatacttaaacatttgcataaagatgtttttggctgggcgtggtggctcacagccgtaatcccacctttttgggaggttgaggtgagtagatcaccagaggtcaagagttcgagaccagcctggtcaacgtggtgaaaccccttctctaccaaaaaatacaaaaattagccaggcgtggtagtgtgctcctgtagtcccagctacttgggaggctgaggtgggaggatcacttgaatctgggaggtagaggctgcagtgagcagagatcacgacatttcactccagcctgggcaacacagagagaccctatctcaaaaaaaaaaaagatgttttctttgggcttcccttcaccttctatggcttccgtcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagcggtggcacagcatggctgagtcagttccctccagggtgcaaaccctctggctgctcttctcccagttgaactccaagaaaacatttgaaaaagcctcttccttatcttcctaccccagaagaaagaagcgagttgattgttgtggctgcagctgctaccgggagagtacaagaccatgaattaaggtcttaaatggtcatgatgggcacactggacaatgggctcctgaaactacccaaatacaaaatgagacattctgtggatcaggaggaatccacatgtttagaaggaagggccccagaccaatttccaagttcagagaccagctatctgaggttgatattacttaccaaaacacaaaaacattcctactgattttatctcaaacacagttctcctgcaaactcttcccccaccaacgtaccccagcagaggcaatgacatgtacatttatggaacagcctgttgactactgcagatccatctcttcaataagaccaactttccctggaggtcagtgactaaaccaaaccgcaaggcagacggcaacacgaccctcttaggggatggatgccagagaaacactgactaaaatccccactcggggactgtcctagcacattcagttcctcacacagctgcacaggggagcgcgacgttttattctgttacttcaaacactcatctgttcctctctctctcttgcaggccctagactcacagacactggaattagagtcagaaaaattgctttctaatcccaaaactggttttgtttactccccttcagctgtgaaatcttggcaaatgctcttacttctctgggactcagtgtcctcctcttcaaaattagagacttgctccacttagtctctaagatctgatacaaatatgattatttgacttgctatttatttatttatacaaatattagaatatttatgtatacatttaacataaatatatttatatttaataaaaacataaaatttataacattttatataaatttatatcaataatatatatttattgatatacttatatcacataagagatatataaatatatgcaaatatattttatgtaaattttaatacaaatataaaaaatacattttctatataagtatatataaatacttatatataaatgtattttatacatttatatataaatatatatataaatatatatttatatataaatacaaatacttatatatatttatatataagtattaatatataaatatatgtgtttatatattattatatataaataatatataaatatatgtgtttatatattattatatataaataatatataaatatatgtatttataatatttatctatttatctatctacagctattttacacatgtgacaatcagggttgcgatggaagacatcactacaagctggaaaatatgaacataattacatatgcagataacacagatccagagactatctgattgcaaggaacattatagatcacccctatataccataactttgaagctaatttgaaatgtggtttgtgaaagtattatacatttcctgcaatcccctccactgctgctagatggcagtaaaggaacgtgttagaaagtctggggaggggacctcatgatttatttaccgcgcagtcatgatttaccacgcaatcacggtttagtcttgttgtcctgtcataattaatagtatcctctttcacatacaaaagtgtctcaatttgaacattaaactatacggtcattgtagataatgacacaaatgatagcatctctgttgaaagtaaattgtttattaatgttgcagtaccttcatttctttgtttcggtttaatgaaatagattttttaaattatagaataaataaactcgaagctatagcattggtctgctttttgtcattttactatttaaatatatctcagccctacttacagtttgtattagcgatatgtggtgtatgaagcctcaacttaaaaactcagcttggtcttcgtagtgcttctgtcactgtctgcccagcacccactgcctctcaatgtgttccaacgtttcccaattcctacctgctaataaacctaccaggatatttccagacctattttctctgtgaagaaaaccaagcgacattgactttccctcattcatctactaatacataaatgtcaccacatgccagtgacaacggggtaaaataagtaataaaagtgaaataggataaaagaattgttatacatttattggctccggagaaatccaccctcttctctctagtctcctgcgcaccctgccaacaatgtcattggctgtaaaaatacctcatgttcatttaacactctacagtttactgagtaatttgttgtttcattttcatgctttaattatatgtttccaggttctctgagcttttgagctcctgctcttcccagatgggctttcataacaaggccagcccctttctctctccccttccgccagtgcccatcatttgaaccaaattttcttcctgtctctcttacttgattctttcccaacctgtgccttctgtttggtctcttaaaatatttccctattcagtgataactcccttaatgaaggcatctttattgactgccttggaaatcctcagaattatagaaacatctttcatgtccaccttggcatgttttatatgtttcacatatattttcataaataataaaaaagttatatattttccatacgtaataaaaatgtcccttcaacatgcgtaatatataacaagattagtgatcttccacctaatgtcttggacaatgtgacttctgtctgataggtatagtctttgacccctacttactcatgattaaagaaatacctttctctcaaaggaactatctgtgttcacagcgttaagtctcatcctggatgctgcaagaagacgttcaaatgtccactgcccacccaggtatgtgatgctgcctgccatgggtcactagaaggtgatagttaaaagtgtaggctctggaatcaaacaatgcagaccacaattctggctcctctgctcaaatgctatgtgaacgtgagcaagactgtgaacctctctatgcctcacttcctcacctctaaaatgaagataatagtacctacctgaggctgagcacagtggctcatgcctgtaaatcccagcattttgggaggccgaggtgggtggatcattccaggttgggagttcgagaccagcctgaccaacatggagaaaccctgtctcgactaaaaatacaaaattagctgggcgtggtggcacatacctgtaatcccagctactcaggaggctaagacaggagaatctcttgaactcgggaagcggaggttgtggtgagccaagattgcaccattacactccatcctggatgacaagagtgaaactctgtctcaataataataataataataataataataataataatacctacctgatagtattgggttaaataagataattcatgaaaatccctagtgtggtgcctaaaactcaaacgctaatatacataggtttggcctaatattatgaggtgttattatttaggattgctgtgcttcagctttttgttgagtttcacggtttggctcttactggaccactgacagaagcaactccatgactggttattctgtcattacccccagatactgtgcgataccttccaaatctactacaaacaacgagtgtgcatttctcttgcttgttccatccaagaggaaagagatctgtccagagatgtcattctgcttcagtcaacccagccgtgccagacaatatcagcataaatgtcaaaattaccatatgtggtcaacatatgctgatactgtgaccatatgctacatgggacttgttcccttaattgtgaataagagaactattcgtgtaggtgttattatccccaattttataggctcagaaagagtaataattggtccaatgtctcacaactgtatgtttcatggcaaagattggaaatgaagcaataacttttttctagtaaaattacaagaatgaccttaatttctttctaagcaaacgtagcgtatcatcacaacagttatgttaaatcagctcaataatctcctagaagaacatattataatattcattagaggtggtatgggctttaagagggagaaaaaactaggcaggatattgctatatgtgaagtaccatgctagatatttcacatatggtatttcatttcatccataccagcaacccaaaattatgttatttatccctgttttactaacaaagaaattgaagtttaaggagggtaagtgcaggatgaacactaagccaattgtagagctggcttttgtaatcagggattttatttaattcgatttgctctactatcatcatgttgaattaagaatggcaaagggctgggtgcactggctgacacctatagttctagctactcgggaaactgaggcaggagggttgcttgatcccaggagttcgaggctgcagtgagatatggtcatgccaccgaactccagcctgggtaacagaatgagaccctgtctctaaaaatttaaaaaaaaaataagaaattttcaaaaaagaataaaaattaaaatatatatatattttaaggctgggtgcggtggctcacgcctgtaatcccagcactttgggaggctgaggcgggcggatcacgaggcgggaaatcaagaccatcctggctaacatggtgaaaccccatctctactgaaaaatacaaaaaattagtcgggcgtagcggcgggcgccggtagtcccagctactcgggaggctgaggcaggagaatggcattaacccaggaggcggagcttgcagtgagctgaggatcatgctactgcactccagcctgggcgacagagtgagactccctctcaaaaacaacaacaacaacaacaacaacaaaaatttaaaaaaatgtgtgtgtgtgtgtgtgtgtgtgtgtatacatatatatactttttttttttttttaaagaatgagaaaggaactagaacaagcagagagaaaaagcccaggggcacgacagctaaaggatgactaatggaagttgaaaataggaagctgaaaggtacagaaatactgcgggaagacaaactacaaattatgtggagaaagacaagaataagaacagttcccagaggtctgaacacagcacattatgtcttcttgctatacagtggccaccaaacttgtcaatactgtaggcaaatgctagtgtcattgcttgtggctaagcagaaattttgacacttgggaaggttggcatgagattgaacagttgccatggtgacctgccatagatattttgattgatgatgagtagacacaaagtgccaatgcttaagacctagcttcagatacttaggatttagtggagaggctgttttgactatttcttttcttttcttttcttttgagacagagtgtcgctctgtctcccaggctggatggagtgcagtggcacgatctcggctcactgcaagctctgcctcccgggtttacgccattctcctgcctcagcctcccgagtagctgggactacaggcgcccactaccatgcccggctaattttatgtacttttagtagagaccgggtttcaccgtggtaaccaggatggtctccatctcctgacctcgtgatccgcccacctcggcctcccaaagtgctgggattacaggcgtgagccaccacgcccggcctgactatttctgacatctgacttaggctgcacaggaggtggggtttcttgacagggaggagctaatgtagggactgtgatgtgccaggctatttgggttggggtggagaaaccacagagagacagacataagctctctcccttatttataggacatacctactggtcctgccctaggccccagattctttgttagtggccttttctactgggagcaggtggggcattccagtttcaggtgttctgggacctggcttgaagtttttcactgatggctgcatcattaggctcgctcttttgccctttcctcagttcctgtctttttttcactttcagtcacctagaaacgacaatatccaatcagaagttgagaatgagacaagtttgggaagacattgaggaatgtctcatattgtggtattgataaatctagagatggggccacagcttgcttatagctgcttagagtaaaatgattaatcagaaaaagtaatttccaaggatttgtagtcagtctgcctgaggctaatacatttattcacagcaaaatatctgctgcctaaaatgactctgcaagttacccctacaataccagctactcagagtgatgcaatcacctggttgcaataggaaattatcctggcttcagttatctagtagaacaggtgtacatatcaatcttagagctcttgagaagacccagtagccccagacccgtgcaattatattataagcactcaagtaacttctcagctaaaggaagaatgatgaagcaggaaagagagaaaaatgatttgtattttttgtggttaacttgcttagaaattttagggaggataaactcaatcttgactaataggaaatttaattaatttagagagttattaaataatagctcctccacatcagggactatgataaatgttattaacaacacaaagaagaataagactttcccttctaggaacataccatttagtgggaagaaagacagacagatacacacacacatacacacacacatgcacatacacttaaacagaagtggtagaggctgagggaaatcccataagatagacataaagaaagtgctccatttgctcagagttagaggtgaaaaccaagaatattggcagaaaagaatgttttaaagcaactttgaatgattcttccaatgatattggaattagaaaatgaaggtttaggcagagtggggagcaggacagtcactgaagtgggaaggcacacatgggctcagcaaaaccggagcacagtgtaatatcattaggggtgaagtcaagaaaagtagcttaaaattaagccatagagaatccaaagattttaaattttcttttgatttcaaaaatgatcttttcatattattgagccagaaaataattaagtcatctatatattagacaaagttgtcaaaagcaactaaatggagggatgttaaaatgggaaagaaaaaagctagcacatttaacctatagctaacaatactgtattatacacttaaaaatgtgttagcagggtaagtctcatagcacaaacaataaaataaatttcttaaagaaaaagttaactattggaatagcctagacaagaaattatgaggctttgaactgaaacaacaggaacagaatttgaaagaggagaataaacccttgggatacagaatgaacaaaattttaacactgtctgctgtaaaaagtgagggagatcagagggattaaggtgacccttggatttcaagaataaaaatatggccaacaaatccagggaacacagatgaaagagaatattcaataaagaagacatacaaattcaaatggggtcattctgaaattgtggcacatttgagatatcctcatatctatccttataatcaaaacaaactcactatctgctcattctatgaccagtgacctcactcactgctgccttatacttcagggcttacacgtagacacacacacacacaggcacacacacacacacacacacacacacacactaagaaaagtagcttaaaattagaccatagagaatctaaaattttaaaatttagaacagatcttcatctgagccaggaaccattcatctatggcttctgtcatttaatagaataaacaaaatctgcatatgaatccatgcagaactccaagttcagcatggtttctcactgttctcagagctggtacctgaagctgcaggtgtgcattctctgccacactctgtaatggatgagtggaaattcttccataaagcttttgtctattgggagcaggtaagtctaggcaaagtatgcacaatttttttttctgggatacccagtggaaaaaaatagaaaagcatcatttttaaagtactgaaagaaaaaaagtcaacctgaaacaacctcattctagccagggaaaattagtcatttcaagaaaataagagacaatcagactagaaaggaagatataaaacaatctctaactacagttgacacttgacataatcttgtatatagaaaatatgaattctcatacacatacacatgtacacagacaactccactagatttaataggcaagctcagcaaggtgcagaataaaagattgataccaaaagttctattgtatgtctgtatgttagcaatgatatgaaaatgaaattaagagcagaattatgtgtataattccaacaaaataataaaatatcttggcataaattaaacaacaacaaaaaaaaaaaacagaaaagacttgtgggctgaaaggtgcaaaatattgttgaaattaaagacctaatagaaagatactccatgttcatgggttggagggcttaacattgttaagtggcaacactccccaaattgatttatagattcatctctgtcaaaatttcaaaattctagttgtattttttttttggaaactgataaaccaaagtaaaaattcatatggaagtcccaagtaccaagatcagccaaaacaatgttgtaaaagtagaaaaaatgttgggcaactcacacttcacaatttcaaagcttattactaaactacattattcaaaacagtatggttctggaacaggataaacatataaatcaatggaatagaattgagaaccctcaaataaattcataaatttatgggcaattaattttagacaagagtgccagccaagaccattcaatggggaaagaatggtaaatggtaccaggaaaactgtgtatgtatgtgtaaaagagtgaagttgtatcttgtctcataccataaacaaaaaataactcaaaatgaattaaagacctaaatgtagaagctaaaactcttggaagaaggcataggtatacatctttgtgaccttggtgtgtatgtaaccagcagcaaatccatatgggtctgcagtaaactcaattctagctcctaggaggagagaatttggccaaggggcagaaagaagtttaaggcagaggaaaagacccgggcaagttttagagtagtagtaaaaggaagcaaagtatacttggaagagggccaagcgggtgacctgagagacctaagggccctgtttagcccttgacttagggttttacacatcaccatggttctagggtttgtgtttctcctcccttgatgttttcaccttggggcaagctgtctgtgtgctcagtggcctgccagcacttgggaggggctgctcatgtagtgttcttactggagttgcgcacatgctcacttgaggcatttttcccttaccagtggggtgttcctagagtcatatgttagttaaactccgtcatttagcctctgtgcacatgcttgagcccactcgcccaactccagagatcttatcgggaagctgctgattacaagctccagatgtttttttatctatgtggaaactgtctttcccggatgctggttgtgactaattatcatctttgagagacagtttaacaaccacctgaccatcacctgatgatcacctgacattctggagtgtgtgtggtgggggtcggggggaggggggagagggggtctcttctcgtgccctcttcatatctgcctacctattctaacaggtatacatgaagcagattcgctgtgcactgttactaattccaggggattgtgttaattttccagggagaaatgcatgaaggatagtggaggtcatcaccatgccaaccaccacttcacagcccactgcatcttgaactgcaatttccatcacttgcctgattcatataacaagttgagcaaagcaaatttattactcacagacaggcagcaaaggacagtagaagcttaggattcatggtgagtttgtctctcaaggctcagaaaaactacacaggatggatagaatcttgcctgcatatgcctcatgttgcattgcagctgagtggctctgaaagtgcactctgtcctgggttttaaacccaggggctacatttaatgggttaaagcactgtgggacatcctgttccaggagagacaagaacagaggccaggattttcctgccagttcctcattatcacaggatgtggtattgctagcacatcctacagttattcttaagaactataaaagagaaaagggagatccacattgccaaggccatccagggacttatccttcagagtaggcagtgacttcttaaatatgaaactcaaaacacaggcaaccaaagaaaaagataaatttgacttaataacattttttaaagtctgtgcttcaaaggacactttcaagaaagacaaccccaaaatggatatatacttgcaaatcatatatctcacagggaattgtatcaaggatatataaagaactcttacaactcaataatataaagacaaataacctaatttaaaaatgagaaaggatctaaacatgtctccagagaagatctgcaaatggccaaaaaatacatgaaagatgctcagcatcattagtcgttagtgaaatgcaaatcaaaatcacaatgagataccacttcacacccagtaggctgtaataaagatacccagacaatagcaggtgtaggcatagatgtgaggaaattgggaccctcaagaattgctggtgccattgtgtaaaacagtccagcagttactcaaaagttaaacatagaatgaccatgtaacccagccatccctctcctaggtatacccctcagacaataaaaaatatgttcacgtaaaaaatttatacacacacttcaaacagtattattcatattactcaaaaagtggaaatatccatcaattgatgagtggattaactaaataggttttatttctaaaataaaactggtgataaaaaggaacaaagcactgatacatgctataccatggatgaacattgaaaagctatataaagtgaagaaggcaggcacaaaggggcacatattgttggacttcatttatataaaatgtctagaatagaccgggtgcagtgactcacgcctgtaatcccagcactttgggtggctgaggcaggcggatcatgaggtcaagagatcgagaccatcctggccaacatggtgaaaccccgtctatactaaaaatacaaaaattagcttgtagtggtgcgcgctcgtagtcccagctactcaggaggctgaggcagaagaatcacttgaacccgggaggcagaggttgcagtgagccgagatcgcaccactgcactccagcctggcaatagagcaagactcagtctccaacaacaaaaacagagtctaaaataggcaaattcttaaagacggaaaatagattaatgattgccatgggctgtgggaaggaataaaagtgaaatgacatctaatgataaagaatttctttctggggtgatagaaatattctggaattcatggtgacagttacagctttgtgaatatactaaaaaccacttaattatatatttgaaagggtggatgttatggtatgcaaattatatttcaattttaaagaaaatgtcaacactcaacatgaaaatattcaaaattacagctccaacatcagaataaagactatatttttggatctctaggattctgatatgagtaagaccatgagtcattattatttggacactaaatgttaacatgatcttatttattattcaagtcatacacctaactcctctggggtgcctatccaatggagtgagattgtgccttgtttcctgtatctttctttcactactcctgggacaaagtagactttcacataatttttattcaatgctgcaggatgagaaaggacagaaaaatgggaggaagaggctgggcgtggtggctcacgcctataatcccagcacttcaggaggccgaggtgggcagatcatgaggtcaggagatcgagatcatcctggctaacacgatgaaacccagtctctactaaaaacacaaaaaattagccaggcgtggtggtgggcgcctgtagtcccagctactcgggaggctgaggtaggagaatggcgtgaacccaggaggtggagcttgcagtgagccgagatcacgccactgcactccagcctgggtgacagagtgagactctgtctcaaataaataaataaaaaataaaaagggaggaaggaagatctctcaaacacaggcatcccatgcatgactacagagaatgatacagataggtatgcagaataacgggacctgaggtcagagggggaagtctttttagagtttgttctttgaatcacttatattgaaaattcaagtggaataagtgaaggtgacaaaagtgaattacaaatcttaaagttccctgaaaatgcttgaagccatcccttagctgaggtgtgggagtgaaaaagcaaactgagacaatgtgaaatcattttctatctcgaattttccctccagcaatgttggtgtccacttccctgtctcttaatgggtgcatctatatatcacctcttgtcaatacctctactcagcaacagccagaaaatagaaagattatataagccaataaaaggaaaataaaggaacaaaaaataagaatagtggagagatcatctacttgggaggctgaggtggggaggattgcttgagcccaggaatttgggaccagcctgggcaaacagcaagaccccatttatgaaaaaaatgaataacattatctgggtatggtggcttgtagtcctagctacttaggaggctgagatgaaggactcacttgactgatcctaggagattgaggctgtaatgagatatgattgcactgctgcactccagcctgggcagcggagctagatccagtcttgaaaaaaaaagaaaaaaaaggtgaagagggaaaaaaaagaacgagtaatagaggtgcttacttcacaacactaacctcacaaacacacactaagctaggttgtgtgtataggtcagaacaaaagatctaccatttaactgacatataagattggttctcgaaaccataggacccactggaaatggtgacctcacaggaagatgcatcttgtaggaggcagctgtgaggtctggttccccgacgtgctgcagcaagtgcctttgccctgcctgtgggctccctccatggccaactctgctatggacaccagagtactctgctgtgcggtcatctgtcttctgggggcaggtgagttttcagctaaaggatcaccatcactgggctttgttttgggctctacagcagattctcaaatataccctggacctctgtgttgaccaaatattttgtgaaaggtattgacatttatatgaaaacaaataattgcattatggagtaaaaagcaaaattcatgtgagtttttaaatgaacgcaggagacttcaaacaggctccttcactgtaagacattcatccttctgccattacaactctgtctcatgcagtctcttctcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccacccacattgatgcagagccacatcctctcagtccacaaacatcctccagacctgccttggaaacagcggtgggccaggaagggaaacgcgttacctgtacagtgaacaggtcagctctacggtattctgcaagttgagggtggaaataggggaggattgtaggaatagcatgaaacatcccaggctacgctcagaaactaagactctgtcatccaaagaacataaagatttttaagaactagacataatttttcagtttcaacattgacttaatttgtcagtttcaaaacacttagcagtgtaactctgttttttactccacactgtatgtcaagttctatatttcatgctttacatcaataattttatttaatcaccaagacacacaagcaaaggaagtgctttcttccttttcaccaagagaaattatggtcctaggagttaatttttagaaagaaagagacagagagatgggggaagaaaggggaggggaggggacaggaggagaagggaagggaggggaagggaggggaggggaggggaggggagggaagggagaaggaaacctagtaggtggcaaaaagcatttggctcaaagggttatgatttttatctcacatcatgctgcttagcattcttttaggcataatccttgttctgttccttgctgagtacccgtgcaggtttttacggatgctaggttcaagaattcctgctataaaattatagaacatctgagagatgatggaaatagagttggataaatttgtctagaatttagggaaaaggtctggcccacagatattgttcattagaaatgtgtcacctcaactttttgtcttaatgtttgtttttattctcatcactcaacagatataggccacctacagaaaaagatttgttataatttgctttgatgaaacaatttcataaaatcaaaaggcagacaaaagcaaagtcatttcaaatatatgtgcagactaagtccagcctcaccagcttggagtataaaccatgtgattccactgcagtttttgccctttgattttctaaaatcatttaatgtactcctgcccctccctcactttacccaaaaggagaaaaacccagaaaatcttccaggaagacagaagagggacaccggcttgggagcctgagaaagatccagagagatttccagaaaaagaccaaccctgagaccccagcaaggctgcagagaagatggattccaaacttcatgccatttaaagcaccagacatgtaatttaaagaaacagtcttccaaaggtagtgctttacagggaggggaaaaaaaggcaaagaggaagaaagagggtcttctggcaattcaatagtgaggagaaaaagaggaaaaaggggaaaactgagaattctgcaaaacaaaaggaaatcacaaatcaagaggacccacaaccagccccactacgaaaacaaacaaagctcactaaggagtctggattttgctagaatgatggccaaaggaacattagactaggaattttgtaaaacacctcaataacacgaaaatgagcaagatgaaagtaatacccgtacaacaaaggaaaacatctcacctctgttccctgttccctcatctcaaaagcaatcatgagtcagaagataatgtaagtctacactccaaacagaaataaatacactcaaggaagcagctgaggatataagtgaccataaccagaccaggactttaaaaactcagactacaaatggccaaaatgggaagacatcagaaaaaaacacaaattgattgaacccaggagggacatgaaagaaaaagacaaagttatcccagtcatgcaaaataaaagatgaccaagggagaataaacccaaatgaaaatttagtcaggacattgaacaaaggcaaagaaacaagtagcagaatgagaaggacatgagtgaaaccagccagttagaaggcggtcaaagaaggcgaggtcttggtatgattgcatgaggggcctggaacagcagcactgggctctgtgcagcaggacggctaagcagcaggttgtcacagtggccacagcactactggccagaccccaggagtcacagtttccctgagagagctgagggcataaacaatgataagttctccaggggatggacttcttaaatactctgagttcatcattacacattctatgcatgtagcaaaataccacaggcacccacaaataggtacacatattatgtatcaatgtttttttaaaaaaaggaaaaataaatgaattccacattcttgtataatcagagtatctacagcgctcctggagtaacccaaaccttatggttgctggaaagataaaaaaccaatgggccaattggggtgaaactctggcccggaaacgtggggtgccagccccctcagcacagatgcaatgcagagttatgggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaagtgagtcctgggttcagggagaaaattcctatctggagtgctgcaagttccaaatctaaggcctccccgagggacagcagcatcaggcgcctccctgggctgtactcaggcatgcctctctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccagtcctgcttccccgaccaggtgacagggctcctctgcactctatgatggcaggaaacgccactcagccactaagcaggtttaaaaaactgtatataactaaaactctatatataaactatgcatataaaactaaactatatatgtatacatttatatataactaaaactttatatgagactaaaatgatagttttatatagttttttaaagtatagttttatatatatataactatatatatatatcattttttaaactatagttttgtagttttatttatttatttactttttggagatggagtctcactctgttgcccaggctgcagtgcagtggcatgatctcagctcactgcaatctctgcctcctgggttcaagcaattttcctgcctcagcctcccaagtagctgggattacaggtgcataccaccacacctggctaatttttgtattttagtagaggcagggtttcaccatgttggccaggatggtctcgaactcctgacctcaggtgatccacccacctcggcctcccaaagtgctgggattacaggcatgagtcaccgtgcctggctgttttatagtttcatatagttatttttaaaaactatataaaagtttttgtatagccacttagtggctgagtgaagtttcctgtcatatatgatatagatatagatatgtttatatatgatatagatacagatatgttatatatatgttatatgttgtatataagatatatacatatagagagagtcagagagacacagagaagaaggaaaagttaatcttacaacccccagcttttttctattttaccgaatgctagatgaatagatggatgaatgaatagaaatgaatgaatgaatagaaaattttcccttctttcaggaagataaaaaagcctgtggaaagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatgagtcagtgaagaaaagaatgaaagtttactgtttagcagtgtggatctctaatccgacttaaaactccttgttcccgattcctattcctcctaagccagagatccctgggtccagggtgagggcacggcattcatgcttacccacgggctggtcaacaaagaggtgctgacctgagagtagggcacataacctcagccactggggtacacttaccacccccgcccccgtgtagctccctcccctatcctgaaatctcccttagcacactaagtattctaggttaaacagcccagatgttcagggagttcattcgccacaaacacacattaaaatgcagacaatttgcctgtgagatgaggaaaattctctggaagatttaggccctgagagctgaaaagggaccctaaacattacctggtgacaactgccctgaggccagagaagagaactcacaatattggtatattaaccggtaccatttgtagttaggctgtcattaatctgggtgtaatggggctcagctacagagaagcgtatccagaggaaatgtggggttcctgcagtcagctggggcaccgaaaagacccagactttagaaccagataaaggctgagttcgaacctctggttcttttgtgatgtggtgaccttgggcaaattaatgtgtgaacctcagtttcctcaactataaaatgtaatgaacaatacctaccacttactattgctgtgaggaagaaaagagagtcaacatgtaccgtgtacagattattgatgtaattcaatggttcttttccccatcctcctaggaggtcactggggagacagggggcagggtcagcccagtgccaaaggatgggcaggatctgaagtgtggaaatggagtaaggctgtgtctgtgtcagaggtgggttgggaagatgtgagacaaacatcacaattttgcctaaggtgaatccaacccacaagtagagcacaggccaacagcagctcactagtacacatacttacaccagcagctcactagtacacacacttacaccagacgctcactggtacacactcacaccagagctcattagaacacacacaccgtcagcttgctagtacacacacttacaccagaagctcactagtatacacttacaccagaagctcactagtacacacacttactccagaagctcactagtacacacacttacacccacagagacaagccccacaccacacggactcacaaatgcagaagaagagttgaccctgccctcatgtacagatagtatgctggtgtgtagtgagaggcggctagtgttcgccacgcctgttgcatcaataactattccacagaacagcatacatggtcaaggaatatttttaatatttacaatgaggactgagtgtttgctaaatgaagaaatcaaaggagtacattctggagggctggtagactcccagagccagggtttttgagatgagagtgaaaataagcaggctgagagcagaaagaaagaaagttctgcagatagaagttaggatattaccacttcggccccagcccagccagtaaatgtttagaagcatagtagtaattagcaggtaggagttgtggggaggaaaggaaactgacatgatgggaagcaggaccagctacaaaatcttcaggaccagctcagaatgaaaatgccggggctcgtgttaaatcttaggatttcaacatggtgacagcagagcactaaaccaagcagggggcccttctagcaggaggccccatggggacctaggaaggaggtcacatccatacaaatgtaaagaaatgtcagagtaaatttcctccattgtccaggagattcggaataggttctcctaagactgatatttcttcattttaatagagttgctcagaaatgaaaaacaatcaatgggaagaaaaagaaaaaaaaaaaagataagatgagtaggagggcaggtccaaaagaagtgattcagcaaaatgaaaggggtcctcagggattaaaggggatgaatttacctgtcatccctaagaatctacaaaggagatgctcaggacagaaactgtatcaacacaactagtagcaagaagttactctgatgatatcagatgtttatttgggaaacttgctagtagagaaagctacatataatatttggatgcaaagggacacagaaggttgaagagtccctaattttgaaataagggaagatgactaactgtctgagctgagaaaactcaggggtacctggaggcagaggaatggataagatgacttcatgcaccacaaaaagaaaaaacctcacattctcatgaacgcactgtaaaaccaaaggatgtcctcatgtgaatgcaaaaaataggccatctgtaaatccaaagaaagcccccagatctaaaatgtctccctcatcccagattccccttcattcctgagcaccttagatttggtataaataacctgcttgggagggggctttttgaattcgtacataatttaaccttcacacagtttctgcaaagtcagaatggtgattattacctcacatgcagaaaaaagtgataggaatttctgtcttaaaagtcttgttggtggacaaaggaagttctaggatttggatcttgtttttttgggttccaatcccttgctccagttaaaaaactaccacataaaatggtgagaagtaggtaggcaagtttttattgatagagaggaaatcaaataatggcaatgaggagacatcacctggaatgttaggcagtgcctaactgggggatggacagacaatgggcagtgccaacccatagggtggatacaaaagacaggcaaggaaggggtagaaccatcaaagaggaataggctggtgaccccaaagcaaggaggacctagtaacataattgtgcttcattatggtcctttcccggccttctctctcacacatacacagagcccctaccaggaccagacagctctcagagcaaccctagccccattacctcttccctttccagaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcggacaagactagatccagaagaaagccagagtggacaaggtgggatgatcaaggttcacagggtcagcaaagcacggtgtgcacttcccccaccaagaagcatagaggctgaatggagcacctcaagctcattcttccttcagatcctgacaccttagagctaagctttcaagtctccctgaggaccagccatacagctcagcatctgagtggtgtgcatcccattctcttctggggtcctggtttcctaagatcatagtgaccacttcgctggcactggagcagcatgagggagacagaaccagggctatcaaaggaggctgactttgtactatctgatatgcatgtgtttgtggcctgtgagtctgtgatgtaaggctcaatgtccttacaaagcagcattctctcatccatttttcttcccctgttttctttcagactgtggcttcacctccggtaagtgagtctctcctttttctctctatctttcgccgtctctgctctcgaaccagggcatggagaatccacggacacaggggcgtgagggaggccagagccacctgtgcacaggtgcctacatgctctgttcttgtcaacagagtcttaccagcaaggggtcctgtctgccaccatcctctatgagatcttgctagggaaggccaccttgtatgccgtgctggtcagtgccctcgtgctgatggccatggtaaggaggagggtgggatagggcagatgatgggggcaggggatggaacatcacacatgggcataaaggaatctcagagccagagcacagcctaatatatcctatcacctcaatgaaaccataatgaagccagactggggagaaaatgcagggaatatcacagaatgcatcatgggaggatggagacaaccagcgagccctactcaaattaggcctcagagcccgcctcccctgccctactcctgctgtgccatagcccctgaaaccctgaaaatgttctctcttccacaggtcaagagaaaggattccagaggctagctccaaaaccatcccaggtcattcttcatcctcacccaggattctcctgtacctgctcccaatctgtgttcctaaaagtgattctcactctgcttctcatctcctacttacatgaatacttctctcttttttctgtttccctgaagattgagctcccaacccccaagtacgaaataggctaaaccaataaaaaatggtgtgttgggcctggttgcatttcaggagtgtctgtggagttctgctcatcactgacttatcttctgatttagggaaagcagcattcccttggacatctgaagtgacagccctctttctctccacccaatgctgctttctcctgttcatcctgatggaagtcctcaaacaccatttccatacccaggcattctgggtccccactggagggttagtctgaagggcaatggctgggctttggaaaaccagcaagatgaggacagagaggaaggcacacagcaaaccataagcccttacccagtgcaggacagaggatgcgggcagacctatgggttacaatgtctggtcatttcccaattccagattaaactgtcacctgttttacctttagttttattagtttgtagtcttaacacctccagcttctcttgtttcaggatttgggcttaaaattgagtgctactctgcatgtctagtttgaaatactagagaaggcagagttgagacaactgatatgtaaagcctggggaagagtgatttctcaggagcgagacacactaagtcaggagcaatgggatatagggcccagtgggggctgaagtgctatgttcagagtagcccttccaatgggcttcttcgtttgatggatggaaaccaaaccactccaaacacaaggtgttaactgctcctacttgggcaaagacagttatcctgtcaaggtaaattctgcatacaggctgaatgcattgtggtaaaacactacatggaggaagaggaggaatgggattaaagaaaaggaggcctagaacagtgagaggggctgagagaggccatgtcgaagttagttgaggaagactgtcaggggagagaagagaagtctgaaagcagagaaaggttgggaaagaggagggagccctttgttgagagcctgcttgcttcaggcctcaggctggacgctgctacctgtgctgtctgcatctgcacaatgatcccaggaacaggtattattttccccatgttatagatgtggaaactgaagattacagttcaaattacttatgagttgtgaaaccgtggcatgttctgctgaagatggcaattctggaaactttttccaagtagttaccaggatggtgggattgctcctggtatctgggtgatcctagagcagcttctcccaaactccaggcagggcccatggtaacacactgaagacaccttaatgccttggtgtctttgtttcccacggctgccgtaacaaagtaccactggtgggtttaaaacaataaaaacttattctctcacagttctggaggctaaagatacaacaccaagatgtcagcgggtcatcctgtatgacagctctaggggagaatcctttcctgcttcttcccatgtctgatggcttctggcactccttggcttgtgccagcatcgcagcaatctctgcctctgtcttcacatggcattttccctgtgtctctgcatttaagctcccctctcctttctcttttcaaggcatggtcttaggatttagggcccaccctaaatccagaacaattttattgagagatcttaacaaattatacctgccaagtccctatttccaaataaggtcacattctgagtttctgagtgggcatgaattctgggggaacactcttcttcccactacactggggatcttggaactggagaagagggttctctggtggcagcttgcaaagaccaggaaaggatgtgctcacagcagggatggggcccaggaaactcatcacatgccggtcatttccatcagtcgtaactatctctagactgctcaaaatgcagtatagtattttgttggctattgttgttacatatgtgctggtttgttttcatattggctaaaaaaaagcctaaaacaaaggggacaggctttaggccctagaccaacattcatgcttcccactccttagacctgcgtggaggcagcaggcatatccttgtggctcctcgcaaaggtaggacaggaggatgagcagccgagggaacaaggaagcacttcagagagagcagaactgtgggggccagagggcacaggctaggactggggatattggaggatagtggtttgtgtgggcagagctgtgaggggctgagcagctgtagtgcaagattagagtggaggtgggaagggggaaacaccttgtagaagaaagatagtgtctgttagtttgatggccatcatcttggggacgtggaaaacggaggcattagcaggtgggaggatgtgggaggagtttcttgttagtaccctagagtttgcaatcagacccaggtgaatgaattctcctctggaggataaaaggccatgtgaattttaccctctcagtccaggggacttgacagagatggagagagcttcaagctccatctggtcctcccaacaccctacttgacccagggcaggttcctcttcccaagtttttacagccatttccttgtctctctcaaacaacacccccaacattcagcacgcatgcactgggaagtgaatctcttctgcctctacctgcctttttctctagaatcgaagtggattcttctgggccaattctgggcatcctctccattcttcctcaggtaacactgagaaaagatgagttcgatgtagggcaatcatataacttactgtaagaattgagataccattgaaaatgaaaggggcccattagccacatgggatgctggaacaagaggagtaaaccaggaatggtcacaaggcccctccagtggagaggctctgagggagtttctgggtgcagcattattcctgcaaagggaggtactaaagggactccacaccaacctggacttgttgactgtttcaaacctcagggctgacctaagcatcatcctatgaagaaaccatgtggacagaatatagggcaaggcagggacaacagcatcctacacaggtgacacccagtgcagagcaaagcatgcttacttattgaaaagagttacaagaaaagcatctctggaagaatgtctagggtaccccaagttctcgctgaacttagcatggagtagctcttaaagagaagaacttcacctgtgacctttacagatttatttgggaaattggaagaaaaagggggtcatccaaatggttgcgtaataaaataacttctttgtgggggaaatgggattcccgtgagcatcccagagccccagtcaccatcacttcctgagaggaagaatcttcccatcagcaccagtatccatagagattttcctactactaggctcattgctgggccacataaggttggggagtggggatggtcgggagctgctgggacaatccaagagaaaaaggctttttctctctcgagggagtgatttcataataagagtttgagataagggcaatggatcctaatagatattaaagtctccatttccgtccctgagccatttcctcatttttcttctgtagtggcccagaaaggaggggtggagatagactgatatcagcccctaacagtctgtgtgacacacagccccaaatgtcctatataggagaatctttgtgaggtttctctggttataaatgaatgtgggaatggaatattggtgctttgagacctctgttgaagctgcatagtgaaaacaaaaatgagtttttgcttcttcctcaggtaacactgagcaaagatgtctagccatattttcatttaggggtgttgggagatgctggtggagatcacgggaatggctaaaacccagaggtgaactcagctttgccatggacccatgagtgaatccattttctgcttctctactgacatctcagactcatcaccaggttcacttttaccatgtcctagaaactcccctatgctatataagaagactcatagtatagaatggcatgaagcatggccaacagttttaatcacagttcatttccattgcttgtggcaaactcccatggctcccaaaaagctgatttctgaggcttgggaccccataacctaagactacccaacccacctagactcaaacacaacatattccctgccttattctagggttgaatgttctttcctcctatctggaagccttccttttcttgctgtctgtgtttgtgaatttgaagttcctgggttccttaacatccctacatctctgcctgtccttttattttttttattgtggcagaacttatgaatcatctccctccaacagacatgatattttctattcgccatccccctctcctatagactcaactacatgcctttctctcccatctctatccatagtctttatctctgctgctggtggactcctgagagggcttcttggggaatatggggccccaaaaatgagtgaatggcttctgtaggtcagcaaaaaggatctgaaaatgagcctacacctgtgactatttccaaaggatttttatcagcttgctctgcaactgatctcaactgccctctgtgaatatgagcatttaatccacacaacatgtaaagctaattctcagctcctttttgccaacctacagttgctattcacttatctctgggaccctatagtccccccaaaagccctctcaggtgtctacatgcaacagagtgcccatattctggcaagaacccataaatctatgcgagacagaatcattagaaactttaaaacttgagtttttggaatggaaaaaaagcatgtagtggatggatgaaaacattatcatagcaaagaagatgttgtaatgcagagacctgggtttaagccttagttctgtcatttatcaactatgtgaccctgggcaagtgatcacctctgagactcagttttccttgctgtaaaatgagctcaattacaagcccaacttcataagatcgttttatctcatttaacccacacaacatgtaaagcttttagaacaatatcagtaagtattaggtgttattataactactaccaacctgaagatttttttcaggcaaaacattttcagttttctcaattttgttattatagggcacagttttgagcacgtcctactttccatagcccaatcactcccttctgaaaacattaaagtttgtttttatccctctatcttttaaaaaatgtgttgtacaggacctgacccagcaccaggtgggttctgacctacaaagagtaaagggggaactttgcctcctctttctcaacatcttatacgttagttggttccattaggacaatttatctactttttgtacgctcaccatcccgttgactcacagagctcactttgactcaccccctgggtgttttttcacatatccttctttcacatattccccttcctgtgttcatatagatggttttctctgtttggtgggggaggagggagagagagaatgtttatcatgtttattcagcttatctctccaacctattaagattctgcaggattctaattttgtgattcattatatttatccttctatcctcatgccatctcagatatgatcatcttgcctgattcattactataagagtgattcatgaaattcatagcaagatcacagctcaacagagaccccacattccccaagccttgtctgaagtccaggagctgctaaaacacagagaattagcttctggtcctcctctggccccagctgcatggctctgaacaactcatttttattctctgggcttatatgtcctcctctgtgatatgaggacattgggtaaagtgatctctaagaatcttcaaactctgctcttcagattctctgattcaaagcctgcagtctctgaagtaccaagagaatgggaactcagagaagctaagctcttcctggcctcaaatcatacatatctgtgacatagtctcagacagtctgatggtggaagaggacagcactggcactggagtcccacagttagcaagagtcaactggagccctgacacctgttccctggccctcctccatcaaaaaggtctagggccatgaatgacaagaaaattgtgttaaaaaggagagtggccctgaatcaaaaggtgggaagtaatgagatggaaatcggggtcttttaggtaatagctgacaactggggtaggaatgggggttctgagcccagtgctggctgccgggctgtttatctctgagtcacatcagcaccaagccacagcagccacctgccctagctccatctcttacagtcacaacaggatgtggtttgacatttactgggtcctgcatctggggtgcctgtgaaagttgctccctccacccacccaccttcagagcatcatgagaaccacactcaccgcatccggcacccaaccccctcctatgctgctctttctacctgggcccctggttagcatcctggcagtagaaatagaacttcagaggggaggggcagggtctctagaggggaatctaggtatcccagatccatgtgcaggcctcccctcccccaacacatctttacacctgctggaggttatgcacaagatcaaaggccacagtgggcaccatgaagatagtggagaatgaaaaacagctgcaataactgctctgacccagttgggatcccttctggtcccacatcactcaggcaactctctcttcccacctgccccccaaactcccttccacctccctccacatgtatcctcccacttccttccactcatgtaatgagaggtgctgatgagtcacaggagaggtagccctagataaccaacagactgcaaaacggacagtccctggatgtctgagccagtgtttgtgcactgcattgactggctcctcgtagttttttcctgtagttgctaaagcctgtaaggtctgtgtgatgaatattttctaacacatcttagaagaacataatgcaagacagaatgaaaaactagagaggcagaaacccccaaagtaagtagtgggaaattaccaggtatataataggtcaagcctgctctgcaggagctcaagggattgtagcattcttatcccaaaccactgaatcctgggcaaaaataagaagtcgcctaattttagtattaccagcttcccaaccccgggcattcttcatcttactcaagctgtccagaggccccagggtgactccctataagtcccatgggtggctgagatctatttagaggcacaagggtatctccttataagtcccatgggtggctgagatctatgagaagcatcttggggagagtgcctctggccaccagcatgtggccctgaatcttccatgtgcaactggccagggaaggagatatatggaaatagtcatcctgcacatctgcaaaatcagatgcaaatcctggaagctctcctagaaaagagacagcctcatctgattaaaggggcaagtgagtttgatgaattattggcaagagacagcatgtctgaacaggatcggtcatcctaaactgctttcctttgtcccctggaattataatgactgtggatttctgagtcctagatggtatggaaacagttatgggaatgaacagtcttgcatgaataagagcagataacatggaggatgttaatttgttctgctgaatttaggtggctttcaagcctctccttcaatgctcacctgtctctaggatgctctgtgcaatgatcaggactttttttcttcagattctctaaaacttacaatattcacatagacctgcacatttctacacaaactgactctcctgcttgcaatgtcattttgcttatataactattagcctcctaaagagctaaacttagctacaattttatgtcctttgtgaagttttccagaatttttgcagtatattacaggaaggaaaaatctgcctcaagtctctactaattctacttgactagtggtgattgcctgagacatttctctattaatgaggattctgaagctgtataaagcccctacagaatcagcatctgaataggcacagcatagggttcaagtttcatggttttgccatccaagcatgtttagcattttaaatattaatatttattacatacttgtagtttatgatttgaaattttttaactaagtcttcctcttgggtaagttgtaatgaaaataatcttgtaagcttaaggagcggaaaataatacctgttgaaaattagagcttgtaatagggctttataaacaccatctcatttaatacacataacaattcaatgaggcaagttttataggtggggaaaaacttgaaacttagtaaaattaaataactaggtcaagttcataacaactagcaaatttttagactacaaaaatcaagtgctttgactaaatcatgctatgactgtgcccaacaccatctcgagtacattttatttttctttttaatcctcaaaatgactcactgtgtccagcaaataatagctgcttaatacataggtgatccttaaagttcagtagggacccctgggcattattccatatgttcttgatcactctgtgtctacatctcagattttccacttcagattaaatgatactagaaatatgcacgtgtctggattgatctaggttaaatgatgcccggaatggagtattttaagacatcttgtgcccccttgtggaggggaagggacattagaaagaaaatctttttaagaacaaggactagggagggatggggatgaggaaggaagctcagttgccaaggtaaccatcgaacctcttcccagccatccacatcagccttttcctctccttcatttccatccaagtgatttctcttttttagagctcaaccattacacacacggtcctcttcttgcgtatctcttggatcaccatctgtctgtctttgctacaaaggaagggctacaagatagtacaacaggacattttttaaaacctcaaacatcaccaaaatttctaagtgcaagtttatttttattttttttttttttgagacagagtctcgctctgtcacccaggctagagtgcagtggcatgatcttggctcactgcaacctccacctcccaggttcaagtgattctcttgcctcagcctcccaagtagctagtattacagacgcctgccaccacgcccggttaatttttgtacttttagtagagacaggtttcaccatattggccaggctggtctcaaactcctgacctcaggtgatcctcctgcctcagcctcccaaagtgctgggattacaggcatgagctaccacgtctggcctaagtgcatgttacctatactaacaaaaccacacttctgcctcgaatgagaacagtctcctgaacatcttgcctctttgcctgactcaaagcctcaggtctaagcctccccataatttctagtctcagcagaaagatcaatgacaggagactctccaggtgatgaaattaaccaattaagtaacctgggttggcatcctcccgtttgttcaccagctcacctcctgccacaggtatatcctttctctcagccatatatgcacaaaccccctccccacggcacacatagaagaatttggaagactagaaaatcaggcaaggtatagcacaccttgagggctggagtatggtagcctgggccgggacatccatacattgagaacttgactatgtgcaggcaaatcacaggttctgcacacatacaattttttgttctccctgagaacttagtagagtcttttgtagaattctcgctttattccattgctttcacattggccagcagtcagaaacctacttacaaatatcctccacccagtccctaagtgaaggcccctggggagtatggttagggctcaggagagggtggggtttttgcacagatgtctgccccacccagctcagtgtgacactccaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagataaagtgccatttacagaggagcaccccagcctggcttgccttccccagacagaggggcagctcaagctcttgcatgacacaggcacctggaatccatcatggggagtagactgggggagccaagatgcaaagcatccctgggccagggaagaccaacagaacgaactccttctcaggagatagagagaactaagaatcatcagatcagcccctaaggctaaattcccatatctgttccagacaatcaggaatagactcaagagtgtcaaaccaacagctcagactctgcattcacgggattggggtgagggtgaggatgagaaaagaggcttgccagagaggagggcacccaccaaagaaagtgcccaggagaagggcaaggagagagcagagcat

SEQ ID NO: 120 - DNA, 61294 bp, Homo sapiens
ttaggggcagaaaaacatttgtaataattaatggctttgagagacacaaggctttgtttgccccagagtattagttaacccacctagtgctcctaatcatacaatattaaggattgggagggacattcattgcctcactctctatttgtttcaccttctgtaaaattggtagaataatagtacccacttcatagcattgtatgatgattaaattggttaatatttttaaaatgcttagaacacagattgggcacataacagcaagcaccacatgtgtttataagataaattcctttgtgttgccttccgttaaagtttaaataagtaaataaataaataaatacttgcatgacattttgaagtctctctataacatctgagtaagtggcggctgcgacaatgctactggagttccagaatcgtgttggtgacaagattgttcaccagcatatggtgtggtgaaaactcactaatttggaattagttcagattattaagcctgaataggtgaaaatcctgaaatcaaggatctttggaactatttgaaatcagtattttatattttcctgttgtattcattaaagtgttgcaagtgttctatttgatggattaagtatatttaggatatacatgttcaatttgtgattttgtatacttaattggaacaagaaagctaataaaggttttgatatggacatctattcttttaagtaaacttcaatgaaaatatatgagtagagcatatagagatgtaaataatttgtggacacaccacagactgaaatagcaaatttaaaagaaattgttggaagaatcaagtgtttgtggaatgagtcctcctagtaaagttcctgctcttgtgaataattaagcctcatgtataattactatagcaaaaggaagcctaagaagtattagactctacttgtatttaaattacattttacataatttatgtgtatgaaaaatgttttaaatgcttattttcgtaagccatgagatagctcctttatattttaagaatttctgaattaatttgcttggattttattagtgcaaatggcagagctagcaattcctttttctgtgttcccattccatcctattcatccctcttttaggaaactctgaactctggattgtccttgtttacatacctgcctcctgcattggactatgtgtctctgagtgtagtatgactaattcatttgtttgtcaaggactctcaatgcatttgttgaacagcctaattagtaatgtctgcaacaatgacattttactgtatttaataaagctctgggaaagtaggatacacataagacaggtctaggtctaaattctttacagaaacttggatttttagttcggtttgaaatttgaagatgtgagtatatttatctcagtttcccaaaggacaagctaattggaattatcatcctctttcacttgattggatccccagaatgccatttacgcatgcagcaggattttataacagttttaaattctgtatatttgatgaagaggttttatatttttggattcaagcctctttttaaacttctacaatatggtttacaataattccttatatcctgcttttgaaatacatattacaactttttaagtttggaaggctatatttcaaggactgaagttacagtatactcaagtgatacacaagcctagcaccccactttccacatagtgttcgataaagattgataaactcgaaatcacagaccttttaattcttaagacaaatagcagcagaaagaaacatctttggcttatttctggtaaggtttttatgctctgtaaaacaaagaattgtattcatccgcgcagcacagattctattaaaaataaatgtgagagtcgttaatgtagtactgctcatttaccatcaaaattcacttttcaggaataatcccatcagtttaaattggatattggaatgagcattgattacatttaacttggtagcccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagtaagtgtgtgctgcgggtttgtgctggacaggcccttctcggcgggcagcccctgcctgcgactgaaactgcctaggctgagaagcagcattcctctatatagaagggactcgctctttcttgtgtagctccccgtaaggaagacggacagaatttgtagtagctgtttatctagttagcccctttgtatccactgttttccacttactgcccgttcacaaacttctccggctaattgcatggttttttgactcaacgtaggcgctttaactttcctattttcttttttccattccactattggtcacaattcaaaccttagtggcgttttagccacccagtgaaggggtgttagagtaccacccaaagcaagtcctggttctgcatctgccttgtgtttgcataagctgttaaatttcctatggtgtctgaaccactcatcacatttcgattgagagtcaaacgctgtgttcagttaggaatttgccggctgaccgcaaaaaggtacatttaaaataagcatttagtcgaaagactctgtattcaggaagagcttggctactcccctccccctgttatagctcttatccctcaccctgttcctactgttttgaaacccgttacaaaaaggggaaagaagtatttccgtcttcaggcctctcagtgtaggtaggctacatttttagcaccagtttcctttatttgctttgttaatgtaatccttctgttgaaaactgttttgtaacttcctggaaaacaaaacaaaacaaaacaacaacacggaattggcgcaggagggctcgttttatcctcccaatttggtgagatctttttgttttctctttactattgcggtttttcctccacagatttcttcacttcttacctagtctattccctctttcctccctcatgataaacagtagactctttcgtccttaaccaactctcttgcagctctttttcattttacttctcagatcttgatcttttctttgtggctgctcccaggccaccctcctccaccatcagtctctgattttgtgggttttgagagattgacctgggagagcatcacagttgcatgtttgtacacacacgctgactctaactagtggtttttctgtatgtgtgtgtcagatcatctactttgacagtcattacatgtgattctcaggctgcccgaaagactgaacataggcagtgagaaagttataaacgtgaacattttgtggggaaaaatacaatgtggagtctaatttacctattgccacttcattgctggatgaaggcacaagtcttaatttcttgtagtcttaaaaaggaacagttgaataatattaaactggaaggaaaagggggatctgatgaaatttcagcgttggtctttcactagattttcattgataaaatttttaagaaagttgtcagggcacaactttaagaaattgtcacatctgaacataaagtcctgagctccagagcaggaaagaaattagtttgagacaatagggctgtgaagactgaccaaagtatatagttgggacataagcttaaattggattcttgaagaagatgatgtcccaaatctttcttgatctgctttccttagttaatttagctttccaagttaagctgagacctcttttctcttttgtcttcctgctttcacctgtccttagagaagggacagcagacagcctggctcttagagcaaatgcttctcatagagatgctattaggaaataggtacctccttcctcaagagttctagttgttggggttttaagtcacgtaactgtacatattagcaggtaataagggacaggatgaaggagggatgacctttaaactctttggatttgatctgcttatattaattttagggacgcaacttcaggatctataaatgatattcaggaattcctttcattgtacttcttggctgaaagaggttttggtaatcgtgtttgaacatgtaatttattcctaaaaaacaagggtgtttgctttgtggaaatgagaaggcaatcaaaataaccacccaccgtatattgagcaaccaaccacagtgtgttaggcatcatattaggatcaatacagatacaatcagagtatttttttttttttttttggagacagggtcttgctttgttgccctggctggagtacaagggtgtaagcatggcccactgcagcttccacctcctggactcaagctatcctgccatctcagcttccgagtagctgggactgtaggcacacaccaccatacttggccaaatgaaaaaaaattttttttgtagagtcagggtcttgctgatcatttgatctcgaactcctcggctcaggggatcctcctgccttgtcctcccaaagtactgtggttacagacttgaaccacctcacctggccacaataatcttaattctgtgaagtgagtagtgttattcctaatttacatttgagggattttcagctcagacttggcagaggtctaccacttactataaccctggctggtgttcaaacttaagtcattcagatatcaaacccatgctcttttttaactacgctagttataggtagaacattaaatgagatgtagattatttagcacactgctggaactgcaatttgatacatatattttgttgaaagtgggtgaatagcactagctttatatgtgagtaatcatactctatggttgggctgtgtaaaactttttattaggtgactgtacaatgtttatttcagatagtggcttaaaagccacttttgtatttatccacctgaattatgcgcctgtcagtatactgttaacagatgtcagaatatggtttttttatgtgattgcagagggagacttcaattcagaattttatccttcataacattatagtgattttaaaagttatatgcagcaaatgtgtagtatttttctcatttcaactttcacagcagtaggcaggtggttgtatccctttttttatagattagaaaagtgggactcaggaaaagttagttcacttgttggaaattctgcagcatattaggacttaaattcaggttttctgactaagaatctgatgttcttttttatttacatcatgtatattgcatgctctttatgtcagggcatggtaatcagatgatacatgatagtctgtggcccattcagtgtaggctttgttttcccctgaatttctacttcaaacatgcttatctggccgctgtttatgcaactactttaaaaaaggaaccataagggaaaaatgaagtcatacaggagaaaaacagaaatgtaattgtagccactgatacaaccaagctcctgtttccactttctctggtctttttgggattttctcctttttgccgttaccctgccctttgatcctatgtccttgcttatgcttgttttcatcaagaagagtctcaatgatatgcagtagaaagaaaccatggtctgctgttttgtgaagagtagtgtgccttgacttgggggtacaggaggaagaggaatgcagaggagtgaggatcatgggaaaatgttgaacttttctgttggagtttcttcgccactatgaaggaaaacattttcccattaaaatagaaatactagaatcatatacataacatttttggaatttaatccaaaacttcatctgttccgttaaaacatacataaagaaaaggagtaataaaataggttgggactaataagcagcagattatattactaagatttttcactattactgtagttaattagttaggtctggctgattatggcttttagagcaaagaataggatgaggaaaatgcagctgttttattatcactaacagagatgtggtgaacaatcctcttagatgttaaaaacgaaactgacccaggaagagagccctcatcagtaccagaccatgctggcatcctgatctcagactttcagcttgtagaactgtgagaaaataaacttatgttatttaaacctaaatacataagtacacctttatctcctttttccattctctttgtatgcttgggatccaggatacacaaattgaagttacttgtttaatgattttataactatgtcagaatttaagttaaaagtgagttactctgtatgtagaaaggctgaaaatagtacaactgcagtaattctgtcagctataagggacgtgtggactgagagggtagtcttaatagattgtgatcaactatatgtgaaaacattttgtgtagtgagttgatgtgtagtttacatgtaaactaactcctttagttcgaaaggaattttattttacgttaaaagattattttaggctgggctttagtggctcacgcctataatcccagcattttgaggggctgaggcaggaggatcgcttgagcccaggagttcaagactggcttgggcaaatggtgagactttgtctctaaaaaaattaaaaaattagccaggcatggtggtgcgagcccatggtctcaggtgggatgattgcttgagcccaggtgatagaacaaaaccctatctcaaaaaaaaaaaaaaaattttttttttgtatgtatgtaactctttacttatctactacctaataatccacaaaaatacccacaaatccttaattacgtggaggaggaggagatgataatagagatcattttaactttgaaagataatggattccgggccagatgtggtaactcacccctgtaattcccaacactctgggaggctgaggtgggacgatagcttgagtccaggaattcaagaccagcctgggcaacatggcaatacctcatctctattaaaaaaaaaattattaagaaagaaaggggccaggtgcggtggctcacgcctgttaccccagcactttgggaggctgaggcgggtggatcacaaggtcgagggattgagaccatcctggccaaccaacatggtgaaaccctgtctttactaaaaatacaaaaataagctgggtgtagtgttgcatgccttttagtcccagctacttgggaggctgaggtaggagaatcgcttgaacccggcaggcagagattgcagtgagccgggattgtgccactgcactccagcccgggcgacagagcgagactccgtctcaaaaaaaaaaaaaagaaagataatggatttggttctgccattagatctgggttggatcctgggtctgctatggtttctgtatccttagtccagtttcttaatttcttgagtcgtcagttgctccgtttataaaatggtgttcagtgatacctgtgtttttagcttctcaggcttgttgtgaggtgaacatataatgtttcatgtaaagcaccttttagatggtaaagcgctatgcagaactgttcttaactattacttctcccatttaaaaaatttgctatctttctgattcttttaagaattctgtgctttccctgtctcattcccctccgataaactggagaaaaaagggcttagaatgatcacccatttttttacctaaccacttttcctgcatttacacatttttttttaaaagagaagaaataacatttttttaagagaaaaaagtcccagagagattaacttcttcaaggtcatagagctggtgacaaaatcaacagacctttgatttagttcattcatatctgtaactttatacatatttctacttaactaattttggcatattttacgcttttttttttttttttttaaaggacagggcctaacatgcccaggctggagtgcagtggtgcaattatggcttactgcagcctccagctcctgggctcaaacaatcctcccacttgagtctccgtagtagctgggactacaggcatgtgtcaccacacctggataatttcttaaatttttttgtagagacgggatctcgttatgttgtctaggctggtctagaactgttggcctcaaatgatcctcctgccttggtctcccaaagtgctggctcatgcctgtaatcctagcactttgggaggccagggtgggcggatttgcttgagcccaggagttccagaccagggggcaacgtggtgaaacccatctctaaaaacaatacaaaaattaaccaggcatggtggcacatgtctgtagtcccagcttcttgaggggctgaggtgggaggatcgcttgagcctgggaggtagaggttgcagtgagctgtgattgcaccactgcacttcatccagcctgggtgacagcgagagcctgtctcaaaaaaaaaaaaaaaaaagtgctgggattacaggtatgagccatcgcactgggcctctgccatttttgagaatatgcttgaacattcgagactttcttctcccttttgcttctgtcattctacatgttggcttatctgacattctagtttaaatttttctcctacctaattttcttaaatgttctttatccatctgtctttcctctgatactatttaaagccgtttgccctgaagtaggcctaccctctcttgtttctttagtaggagctgtcttcccactctgtgtttctgagtgacagtttactcctgttttcctttcccttttctctcccatcaggcttgaaatctttgttcttcttccatgttttctgaagcctgtgcctttctgatatgcctttggattgatgttgtcagcttagttgtttttgtttaatttttcactttaggcctttaaagctaccccaactatttcagtctcccttttattctagcacattcttgggcagtttctttttcttagattttacttctgtgcttacattccaccttcttttccactgtgccctcgtttccacacttggaacattgtctgtgactacatgatggcattcagataatttactaagtccattttcagagcttgtctttgccttttatttcagctaaatctcttctaaaaaaaaattgatatagatggttaaccaaaatcttctcttacaacagtttatttcatgccttatttcgtagtcaaaactcaacttttctgccacctttgtacttcataatcacatttttccataaccaattcagaattagtttcatttctgaagagcttggacagtgtctgttgacttgagatccccataaagttttcatgagtttggaattctcttttttcttattcagtgttccaggtcccatttctttaccaaagcaaaatacgtgtactctttaccctttgttatattttctgagtcctgttttgatactattttcactcatttgttcattcaacaaatgttgagtaccctgcacatacaggccctgttctaggagctagggtgtcctgaataacaacaaaaagccccccttctcatggaccttatcttctagttggaggaagtgtggggtggggagggacagtcaataaacagatgtacaagtaatacatggcacgttaggtggtaaatattaagatggagaataagataaggacagagtgactagggagtactcttttagataagattggtaaaataaggtgacatttaaatagtgacttgaatgaagtgggaaattagttatgtggatatgtggaagaggagcattttcaggaatggtattaaatagcaaatacagaggccctaacttgaaatgtgtttggtgtgttcagaaaacagcaagcacggcactttgggaggtcgaggtgggcggatcacttgaggtcaggagttcgagaccagcctggccaacatggtgaaacctcacctctactaaaaatacaaaaattagccaggcgtgatgacatccgcctgtagtcccagctactctggaggctgaggcaggagaattacttgaacccaggaggtggagcttgcagtgagccaagatgatgccaccgcactccaacctgggcagcagcgtgagactctgtctcaaaaaaagaaacagaaaacagcaaggaaaccactgtggttttagtggaaggagtaaaggatatgtgattgatgtagtaggataggaaatgagatcagtttgtgtaggatatattctggatatattttgaaagtagaatcaaatgagatttgctgatacattagatgtggggtatgaaagaatggaagagtcatgaatgacttaaagggttttggcttgagcgattggaaggaaattattgttttattttgacctaagtcttctgcttttcttctcttgcccccactttttcagtgttgccatttatgatagcttgctgacacttacttcccagccaagcaacaagaaaaaagttatatgttctatattttcacattccttcaaattggctgtgctagctactactactgttgaccttctagccccatcctttcttctctagaggttttaaggtttctctgtgcagtatgcttgtatcagctctaccagtggaaccgccttcaggaattattgcaggaaaccttgcaacacttttagtgttgtctataagtatgtctgtgcttccttgcatgaaccactcattcaagatggcttgtgaatccacgtaaaaagaaatatacgaagtttgaactttaggggaacattagagaaaattgaatggttcaacataagggaagcatagatttagattcaatgtcaaaatgaagtcagaaataaaacatcttcatttaaacctactgttgaaaataaaactgttacagaaaattgggaagaatggaattaccgtaaaatatcaaaaatagttccactgacttatcaatacatgactgtatgatacacatgactatatgatagcttcctaaagtagtgaagaagaagaaagttactgatagcttagggactgtattggatgatctgtgaagatatcagtgttgtatgagcctttcatccctttgatgtggagcctggcattggaattgcaaataaaagtaccaaatataaaataatactggtactattaaaattagaatatactatccaggccttttttttttttttttttttttttttttttttttttttgagatggagtctcactctgtcacccaggctgtagtgcaatggcgtggtcttggttcactgcaacctctgcctgcaacctctgccttctgggttcaagtgattctcctccctcagcctcctgagtagctgggactacaggtgcccaccaccacacctggctaatttttttgtatgtttagtagagacagggtttcattatgttggccgggctgatcttgaactcctgacctcgtgatccgcccacctaggcctcccaaagtgctgggattacaggcatgagccactgtgcccggcctactatccaggacttttgagcataggaagccttgcttttgattctaaagtgagagagggtcacaaaagtatgggtaaacattagattgtcaggtatgaaataatttttaaaaattaaaaccagaaacatgaaacatgaactccagaacccaggaagctgtaatctcatctcaattcagtttaaggctaatttttatgtaataacaccttaataggaaatgtcaaatctaagaagtaaattgaaaaggactaatcataagtttggggaataaaaagattgaccattgtgtttgtctgttttcacactgctgtgaagacctgagactgggtaatttataaagaaaagcagtttaattgactcacagttccacatggctggggaggcctcaggaaacttacaattatggcagaaggcaaaagggaagcaaggcatgtcttacgtgacagaaggaggcggggagaattgtcaaacacttttaacataagatctcatgagaactcactatcatgagaacagcatgagggaaactgtcaccatgatccagtcacctcccaccaggtccctcccctgacaatggggattataattcaatatgagatttgggtgaggagacagagccaaaccatattaaccatctctctgaattttttcttattaatattgatatttccaattttcctctataaatggtgactaggagcttggcttctatagttttgttatataattaccctttaattctatctcaaggcatattttacctgtgtgatgtcttctaccaatttctgttaggtctactctgaaatggatgccttgaaaattgctttttagctaaaaaatttagtgattccccgccccccaccccttagaccagatatttttactgctgcaatagctctattaaccaccccacctttaaaatctttggctacccatttactagcctgggtcttatcctttcagttgttttttcttatatttttcagttttctttttttcctcaacttacaatggtagttttttttcctaaagttcagttcactttctgttcatgactgtcagaagatgtgtatgtagaaggaacttgaacatctatatttctagatttttcttcttagtttgtagtagtcatttattgctacataacagattactccaaagtttagcagcttaaaacaacacacatttgttatgtcatactttctgtagacaaggaattgggcacagtctagctacatcttctgcctcactatttctcacaggctgcagtcaggacattggtcagggtgtgtggtctccttctaaggcttgaatggggagggatctgcttctagcctcactcagtggttattggcaccattaagttcttggcaggttgttggactgagggcttcagtttcttgccacgtgggcttccctaacatgacagctttcttcaataaagtatgcaagccaaaaaggcaatagtgtctgctggcaagactgaagtcccagtcttgtaatctgatgatggaagtgacatcccatcacttgtgctgtattcttttgcaagaagcaagtcattaggtgactttccattccatatgtgtgaggaatcatacaagaatataaataccagttcttacgtcagttcttccttggcagtgtctgccccttaaatgttactattctttatgatctgtggtttgtcttctctttttttccctctagtctacactttttttccccctgggttatcttatgcgctcatggaagcacaagttcttaaactagtttgcctgtgttgaagctcttctgctacttaattgctctctgattttagacacattttctaacctaaagcattaatttcctcatcagtatgataggagttaataacagtacttaatccaataggtctatttgaggacaggtgagaaaataaagaaatactcaacagataatcagtgctcaattagtattagctgtaactgtaacaaataatagtaataacaacaatcatgacttcagctattaggatttgttaaagattccttcgtctgtctcttactttggcatctgtagaggactgacagacatttctacctgaattttctggaagtattgcaaactcaatgtgattaagactgaagtttcctcttgttggaaggaatgaggattggtaagcctgtctgatgggggagatggaggaacagatttaaaattgatcctgtgaacttcatttagttattcaacagctatttactgagtgtctgatctgtgttaggcactgaaggtaccacagtgcccaggtcaaagtaattctctctgcctttctggagtcttaactgtgtgagggaaatacaatgttgaacctgtaattcccagtgctatgtttatgagatggaagtacaggatcctattgggatcacacaagaggagacctaacttggtctgcaggccaggagaggtttttttttgtttttttttttttttaagaaattaggctaagacttctaaaggttaagttggagttaagtctattgaaagtctccaagtctggaaacagcatgatgttttagaagaacatactttcctttatcagtttgaaaattttgcttatttaaaactaatttcctattagtctcttgttcctcattcccatttacactcttcattgctgtcctggattattacaaaagcctgtttgtttgttttttttctttttgtatctttctagttcattctgtccattgctacttttttataaagaacatttcactaccatatactttctgttccagccacaggaacctgtttgcaggtccctgaacctaccttcattttctagtgctgtgcatttcctcatttctttcgtttggaaagtggtgagaaggtcctctaacttgcttcttgccctcatttctctaagcagagctacaactttgtcctgtctgttcctctggcacttcccatcaccgtgatagcatacttcactgtggctggtttccattcccatttcctctactatagtgagccacttgaggcgagaacccttgtatttccaacattggtgtactcagcatcttgcgtcgaggactcagtaagtattatatttgaattcccactgcaccgctctaattagaattttaaaaatcactttctatctggattgttacacactttttttccccttaattcatttttctccatgtactacccatatgcatcctatataaatttaccaacactcataaaaatcttactcagaaatcttcagaggtttgctaaggatacaatttgattcttacacatttaatgctcaccagctgcttaggcccacaccatttatccaccctgatttgctactgctctttgaaatacaaccagtgtttcagccagactgttttcctgcttctgctccccttctcctcctcccagcacatctgtgaattctttgactggtttaccactcccacactcctccccagcaatgcagatcttctacaccctttaggatctaagctaagtctgcttcccagatatcctcccgaactctgaatgtcctttgatctctcttttctcaaaaaccttttataccttttattcccaaattatcttctctagaaatctgtaagggcaggggaaggaaaggttttatactattctgtcttcggcagaggacttttattattgcttgttacgtacagtattagtcatatcttgctaacactcagtgaactgccctcagctgatcctctgccctgtacctcacctctgctttaccacctttccatccgatttctaaaactgtagtgggactttttaaaaagtgtgtgagagttttaatcctgttgtggtaaactcgcctttctttgcttgctatactgtttctagtccctattttccagataaaaatagcccaggtcagcatggcttgcactatttttaactccaggtactaggagaaaggtttgctctaaaggtgaaatgaagttttatgacgttgcttaggccaaaagtcagttgatgaggttatgaactgcaatagaactttacacatccatgaatctaatggagagggcctgcatatcttatgtccctcacccctaccaatggtgtgtgaatccttcaaaacaaaacagcataatagacataatgttgaaagtgacttctttatataccctttttataagacctagaagaaaaaagcttgtagctagaaagcagatgcaaagttcaacattgataccacgttgatgtgcagagtaaaattttcaagagcaaaattttaagcttctaaaattatcatggatttgatttggttttcgaactgtaatttactcaaaatgtcaattacgtggaaggaggtttaagagttgtatttaacaaaagagggcatgagttaattaagttgagaaatatttcttttatgatgagaaaaccttttggccttaaccacatttctagattcaaggatttaatcaacgtgggagaagcagttgctttaactagattaaaagagggccatggtggagtgtagataaatagaaatctggcagtgtaaaggtcatttgaatctggttttctcacacattcaaacatttttatccttaaaacaaaaatggcagtttgacctgccagttttgcttagttttgatgcttaaaatgtatttttattctctgattacagagttggtaaggaaagtagcctaagaaatatttaccacagatgatttatgtgcaaagagtggttgtagttttgggtggttacaacccaaagtattttggaataaaatgtcttgaataaagaaattttgggctaaaggtcatgtgtgataataaaataacacccttttccgatagcttagaagttttttccaaggcggtcatataagctagcgtctcacaactttgttttgctgctggacccctttcagaatctagtgggagcggtgcactttctcacactcaaaatgaacatagtacacacaatgttctgcttgtaataaagcccctccatagaccctatgttaaaaaccccgttagagttccaaaaaaccataccaaaactaaacatttttaagcatttcatatcacgttatggtagaataaggtttctgtgtgtgttcagttcttgctccctccctgcctttagaactatggtttgagtttcttttcccccataaataatggtatgtatatcctatggacttctggaagatatatgccttatacagtctggctatagaacaaaacaaagttaaccggtatataccaggatggaaactaccatatagtgataatgtcttctctggagggcatacctctccagacacatttgctaggttaattcttgctttagaattctagatgtgcagttgtaccataaaagactgagagtctttatcactaataattaacactggcttatgattctctttttcctcttgtccttttaaccctgtcctgtcccctgctcccactgcctctgttctcgtttgttttgcatttttgtttttccttgtaactggcatttcagtagtattaacctgaaattttttttttttttgagacggagtctctctggctctgtcgcccaggctggactgcagtggtgcaatcttggctcactgcaagttccgcctcccgggttcatgccattctcctgcctcagcctacctgaattaaaaaaaaaaaaaaaaaaagccttagtaatagtagtgctccgcggctggggaattgggtgggggtggggggtggggggtgcttactaactaaaatgaaactagaattcatactagtttttttatattaaaatagtttctataatggttagatctgaaacatctctggatagttttggtagaaagtatctgcagaatatggaagaataatttgttcgtattgacaattttcaggaactatgctttgatgttgcatagtagctgtaagctttttctttaatgtgtgcctactctagagattcttggtgtttcttcctcttagaattgtctggggaaagggagaacagtagtgtggggtggggaagatgtttgtggacagaagccaggaatgggaataggacctgctagtattgccttggattcttgtcatctggctctctactactgagcaaggcactcaacaactctgccagtctctccatctatgaaatgggagtaatgctgacctaattaacagaagagttgttgagtagatgattatttgtaaaagactttttaaaaaagtagttatattggctgggcatggtggctcacacctgtaatcccagcgctttgggaggctgaggtgggcggatcacgaggtcaggagatcgagaccatcctggctaacatggtaaaaccctgtctctactaaaaatacaaaaaaagccgggcatggtggcgggcacctgtagcctgtagtcccagctactcaggagactgaggcaggagaatggcgtgaacccgggaggcggagcttgcagtgaggccagatagcgccaccgcactccagcctgggcgacagaacaagactccgtctcaaaaaaataataaatataaataaaataaaaagtagttttatttctcagcagtgccttttcagattaggacttggtcttagttgcccttaactctgttcttggtgttggttaacattgtcatcagaagttcagattcaattttagattcagaattcttgacttggttttactgggatgtcagaaccttatttttaattaaagcgaatctattgttgcttaggcagttggcacatagatttggcactgtgagaaaggaaatagtgttcagttgataagggcatcttgaactgaatttcagatagttgtgttacttaatgggtaatgaaataactccagctgaggaacaccttgattaaaaaatctttctctcctcatgccttctccgttagcagattgaagtcaagtggcaatattttatttataatcatgaatttaattatttaagctatattaaaaaaattgaaacccttagatgttaattaattttaaaaactagtgatggatgcaggtaagctagaatgattggatcaaatctcacacacaaatgagtttattctttaaaaaaaaattttttttttagagacggggtcttgctatgttgcccaggatggtcttgaactcatgacctcaagcaatcctcctgcctcaccctcctgaatagctgggattacaggcatgagccactgtgcctggccttattttacaggtcttactgacgtaagcccatatttgatttgttttacagtttgttgatattgcttagtatttcttttatttactgtatagtctataacttaataggtagcagtaaaaacaaaataataaaagttatttattttcctcctaaaataatggggggtatttatggcttatttacccttaataatgtcttttaagtggccattataaaatatgtagaattactttggtgtctgtgctgtcaaatttggctcatgtagtaattgtgctcgtagtaaaaagtgtattttaagcagcctgtgttgtccttaagaaatttcatgtaggttccacacttttttctaaaattaattattcttaacatttttaacagtcaaaacttgaaaccattaagatgtgaactgctgtatgtattataatagggagtagcttttttagtgttgacattgtataaaattagttatttacaaagatagtaaagcttattgtttgaaaataaggaattgaggaaatgaagttaaacaacatgtattcatacctatgtttttcttatagaaatatataatatctaggtatgtagaaatgtaaacactttgaattatacaatactttgaataatttaataacaatatagcttaaatacttgtagtgttatcttttcagtttgggaattgcatatatattttaactgtaaaaatctttttttttttttttttttttttttgagatggagtctggctctgttgaccatgctggagtgcagtggctcactgcaacctccacctcttcccaggttcaagcgattctcctgcctcagcctcccaagtagctgagtgccaagtacaggcacgcaccactgggcctggctaatttttgtatttttagtagagacagggtttcgccatgttagccaggctggtcttgaactcccaacctcaggtgatccacctcccttggcctctgaaagttctgggatagcaagcatgagccactgcacccagcctgtaaaaatcttacatgtcatgggaaagaggctgctgctttgtttatgactttatatagtttctgattataaaaataatacagtgctccaaagtagatgaagcaaaatctgatagaaatgaaaggcacaatcaacaaattacaattatagctggaaatttcaatacttctttctcagtaattcttaaataggaaatcaacaaggatataaaagattctaacactatcaaccaatttgacctgattgacatctgtagaatattccttgcattaacagcataaaatacgttatttgcaagtacatatgagacatttaccaaggtacaacaggtgctaggccataaagcaggtcttaataacttaaggattgaaatcatacagagtatattctctaaccactatgaaattaaattagaaatcagtaataaaatgaaattttgaaaatctcatatgtggaaattaaacagcgaatttctaaataacctatgggtcaaagaagaaatagatgtagagcaatggtacagggtgaagagttcagaaatagacctacactaacaatatcaattgattttttttttttaataaagatactaaggaaattcagtactggctaggtttttgttcttttttttttcttctgtaaatggttttggaatacatggctatctatgtggaaaaaataaaccttgacccttatgtcccaccatttataaaaattaattcaaaatggatcactgacctaaatgtaagacctaggctgtgtgcagtggctcatgcttgtaatcccagaactttgggaggccgaggccggcagatcacttgaggtcaggggttccagaccagcctggccaacatggtgaaaccctgtctctactaaaaatacaaaaattagttggatgtggtggcgtgcacctgtaatcccagctactcgggagggtgaagcaggagaatggcttgaacctgggaggcagaggttgcaatgagctgagatcgcaccactgcacttcagtctcagtgacagagtgagactccatctcaaaaaaaaaaaaaaagtaagacctaaatccataaaactttaaaagaaaacatcagagaaaaatccttgtgacctcaagataagcaaatattttttaggacataaaaaagatgagccataaaagaaaaacactgataaattagaccatgtcaacattaaaacgttttgcttatccaaagataccattaagaaaatgaaaagacaaacccttttgagagaaaatatttacaagcatattcaacagaagacttgtatcagaatgtctaaagaatgtattaataagaagaagagaaacaacccaaaagaaaaataggcagaaaaattgaacagctttttcacaaaagaagatacaggaatggccaagtgcatgaaaagattctcaacatcattggttaccagaaaaattaaaaattaaaaccacaatgagatgccactatacatacactagaatggctaaaattaaatatattgatgataccaagttttggcaaggacatggaacatgtgcaatcctcatacattcattacttgtggaaatacaaaatggtacagccactttggaaaacgggttagccatttctcataaagttaagtataaatttatcatatgacccaggaattccactcctaagtatctatcaagagaagtgaaaacacgttcatacaaagacttgaatatttttattcattatcaccaaaaataggaaacaacccaaatgtccatcatctggtgagtaaacagagtgtgcttcatcatacaatgagatactatttagcagtaaaatgaagtgaactagtcttttatgcagcaacttcagatgaatctcagaaacatcatgctgagttaaaaattgtaacataaattatttagctcttcatggttgaagtttgtactatttgtaatttttttctgtcacaaataatctgatgccaacaatgcattagatattcttaaagatgtatctctgtacattttaacaaggtttttgtaagaaaaatttctagactataattgctgggctagtgaacatttttatttgcttatattgccaacatttattgaatgcttattgtgtaccaagcactattaggtgctctttctacccagattacctcatttaattatcatagcaaccatatgaggtgcaggtcattactattttcctcattctataattgaggtaactgaggcacagagagatttaaaaacttgttccaaatcacacagctagaaagttaggtaaaccaggatagtttgattctagagcttaacttcctagctaagacatgtgaagttaagtttctatgcatcttttgaggggtgttgtatttattttcaggtctcctacttgatctcactgtatgcattacagaaatttcttgtttatttatttgtttattttgagatagggtctcactctgttgcccaggctggagtgcagaggctcgatctcttagctcattgcaacttccaccttctgggctgaaatgatcctcccatctcagctcctgagtagctgtgaatccagatgtgcaccagcatgcctggctaatttttgtattatttgtagagatggggtttcaccatgttgcccaggctggtcttgaactcctgacctcaagcaatctacccgcctcagcttcccaaagtgctgggattacaggcgtgagccaccagacatggcctctcaattttaaaaggttaggatgagccaaatatttattaaatgagtctttcccttattgaagtaatttcagaaatgcaccattggaatgttgtttaatttcaacaggtacaaactcacactcaaggaaaaacccagccattcactcaaaggaacattattttgatagtattcagatatcgtatacaaatcttttgagcaggttagttttttcatgtaaatcataacatatggtattggtcaagtagtaaagttcatattaaccttaaacatttactaagatactgttttcaagtaactcaggcaatgtatgcagagggtgtcatagtttctgtaagtatataagttttggatcaagatcacattaatgccagggccccactacagatcttctgaatcagagattctgaatctgaggtgaagactcatagctccttaaaattccatggagaaaatatatatatacctactattttcccacgaaaataaaaaatttaaagacaatttcctggagattctaattcacatttgggtctgagaattcttgtgtagggcatactctccattgttaaaggatactaaaaagttacatcctatatctcagatacccaaaggacatttattaagtcttatatacacctctcacaacctataagcttgcaaagcaaaaaggccttctaataccccaaattggtttatattttcttgatagttttaaccctatagattaatattctcttacctttttccccaaggcttctaaaagtagatgatactatctgtctttatgtgatagttgcttgtttgttaacttctttatgacatgtgccttcaagtgatgttctaaaactaaacttttgaaagttgttattccccttgtaaaagggtctgcccttttccctctcctgtgtttttctccttaaccatttcgtagtgcccacaggtagcgtggtatatattggtcaagaatgtaggatgcaaaggggggttgcctagatttaaaacccagctctgccattggctggttgtatgatgctagcaagttatctgccttctcatatttatttcatgggatagtaatagtacttatgtcatgattattgagagaagtaaatgagctaatatatgtaaagcactgtacctggcacatagccattaaaattaccacctgcttctactcgcctctcccctgttggctttattctcctctgttggcttacatgatactgtactgccatggctttctgtgatctcttgaaccattccttctttgctggtttcctttcttctcactaactataaatagtatttctctctggttttggtgtcaacattcttctctatatgtaataaggattataggcctgtcaggtagactggggtttgaattctacccctgccacatattagctgtatgaccttggaattttaaatttcctcaatcctttccaaacttagatttctaatctgtaaaataggggtaattcctttatagcaggattgttgggaggattagagataatataaagtgcccagtatagggtctgaaacactgtagttgctgagtaatgggatctgctgctcctgctgtcttttctagcttattgatctcatccacttctgtatcttcagataccgtcactgaactgttgatgcctaactctatttctctagttagatttccttcttgcactgttaaggtgtatttcaaactgccattaaatgttttctgtatgtcttattggcattttagagttttcacacttaatatcagactaatcctaccctattatcttccttctgaaacctgctgtttatcatgtgttccatatttttactcatgttcttgatctccttttaggcatggtaccttagcattgaattgattcattcattgtctttgagtctgtttctggttcctctctgcgttctcacaccaaggctcaaatatccatcttttgcttcagttctcactactatagttaaaccctcactttatcgtgtgtgtattttttcccccagtagccgtgaatgtcatctccctacctccattattctttgttttccccaatctgttctttacattcatctttctctcttatcagatccatcttcccagagtggatattaggagattctttaccccaaagagtcaaatagtagatagtttgggctttgtgagccttgccgtccttgttgcaactgtttaactctgctgttgtaacaggaaagcagccatagaaatacgtgaccacgtaagtgtgactgtgttccaataaaactttatttacaaaaatgggtggtggtctgggcatggtggtatgcacctatagtcccagctacttgggaggctgaggcagaagaattgctttatcccaggagttcaaagccagcctggacaacataatgtgacccccatctctttaaaaaaaagaaaaagatgttggactagacttggcccacaggccatagtttgctgacccttcccttcctacctttctttctttctttccttttaaattaccattccttctagtatttcttgaactaattatctttttgagatattgactgcaaggtagaatgaacttttagctccctattttcctactgtcatctaaaatatttcggttttaagtgttttggttctcatcatttggagaagtacaaattatgcaattacaaagattccagaaataattctcatagcatttgccctgaatagtagttcctgactctttcttagatgctactaggtgcatgtgttatcaatacagtcctatatactgtggttctttggggaggtagctttaggtctgatgggcttatcagtttcttcagaacctgctttgacctctgtgtagtagtattccatttcatctgtcttatctcagcctttcagatttcactgactgatgaaggaacatttctatttggcccctgtatatttctccttagggtttaggtgcattctgtatcagctttgtggacactttccttatgtgcccttggagatcttcttgcaacattctaatttattaagttaaatatttttgaataccttctgtagaactgtgctgaagacataaagacaaaacacagttctagccttaacaatcctcatgttttgatgcaggggtcaggtgactcccaaagggccagatcataaatattttaggctgtgggctacatggtctctgttgcaactactcaactctgctattgtaatttgaaagtagccatagacagtagattgagcttgactgtgttccagtaaaattttatttacaaaaatcagtggtaggccatatttggcctgcaggctatagtttgtcaatccctggtctagtggcattgtgccaagggatatttgaagccacaggtaaccagtgtgtcttccttgaacgtaattttactcagttattgtggagaaaaagttaagtagtttgatttatattgatttaaaacattcttttaataacataagtggccacccaaggaatagaatataaaatcaagatgactatttaaaatgaaacagccttgcaagaaatgtcttgtttgtagcgaacctcttagatctgtaactacaaactcttctgccatttgttggataagcttgagaagcactgctaggcattgggagctatggaaggatttagaggagggcagtgacatcagattttaattttagaaaactaacttgaatggagtgtggagaatagtttggagaagggcatggcaattctggagggagggagatagataagaagactgttaacaggaattgaagcaaaagataagagcttcttttaagatgtaggtattggaggtagagagagttatacagattagagacatagcaagaaggtttgatttgattgattgtgtagggcaagggaaatggagaaggatgagtcaaggatgatagttctaagtttccgtagggagactggttgaacaaggatgccactcagtaaaggaaataatacatgaagaagagtaatgtgaaggccagggaagacagacaaataaattgctttggaactgttaagtttgctttgcttgtggacatccagatggaaattggttttatatgacttaaggctctggagagcaacctcgacttactggggtgggcatgagattgaatgtaattctccagaggaaaagttgtctatagcaagggtatttgctcatgacagaagccaatgaggggccgggctcggtggctcacacctgtaatcccagcactttgggaggctgagggaggtggatctcaaggccaaaagatcgagaccatcctggccaacatggtgaaaccccgtctctactaaaagtacaaaaattagctgggcttggtggcgcgtgcctgtggtcccagctgcttgggaggctgaggcaggagaatcgcttgaacctaggaggcagaggttgcagtgagccgagatcctgccactgcattccagcctggcaacagagcgagactccccaatctcaaaaaagaaaaaaaaaaaaagaagccagtgaggaaaaaacaaaaactgcctgggtcagtagaggaagggggtggggatgtgtattgaaagaaaaggaagaaaaccagaagacgggggtgttttagagaccaagaaataatagaggttcaagaagatgaatagtaccaaacactatagagagggttaattaggattggaactaaaagacatttattgccttttttttttttctttttaaaggagtggggtaatttgggacttttcctggggtaatttcactggagttgtgggagcaaagtcagaaagcggtgcgttgggtgtgagtggtatgtgagaaaacgtaagcagggaccttagaccagcacttctggtctacattaatgtgtctatgagtcactgggagatcacttggagatcttgttaaagtggagattctgaatcagtaggtctggcatggatgcccagattctacatttccaacaacctcccaagcaatggggatgctgccgttctgacagccacctgaactcagtatcccaaattgttcatcgatgtatcccagagcactgtagctaacttgcaagggtgccatggaatatttttaaatttcaagggaaatacactggcgtcattagattgctgtattagatcactgcattcctttcagtgatgtcatacctttgggaagctggattttcagtgcttgctctgataaaaagcaagtactgcctgaaaatcagtgtggaacaggaaatgaggctgtcagtgttcaatctgagtccagagtttgaaaagtatgcagtgcccaacaggcatccagtttttagaacttaaaatacttactaagtggtttggctcttactgcttaacggaggcaactacagttgttagatacttcttttggccgaggtttaccctgcaagatcactgagacactaaagattctttgagccaagaaagtttggaaccgttgacataggacttcttcatagaaacttgtctgtggagccaaagagagcctagatgattgggcggtagctaaaagaggaacaaaggagcatttattttaaaataaaagagacagatatgttgtatgttgggggagggagcagctgataaagaagcaacaaatgttgacttagagtaaaagatctctgaggaggtgagaaaggatggaatctgttttctctaaatattgctcccaaaccaacactggtttgttggaagacatgaagaacgttattccccactccagacctcctgaatcagaatatgcattttaacactatccctaggtgatttgtatgcatattaaaatttcagaggcactataggaggcaggattggccttatataggagaaagaatgtctcttccttttatttattccatcactatattgtgtactttcccgcatcctagccattctgattgagggaaatgagatgacaagggttatttatttagataaatttagaaatctgggggtgaaaagttgaggaagtttttgcttgtttgccttaattatctcaggtaagtacatagaaaatatctccatctagtgaataagaaaattgggactggccaggcgtggtggcttatgcatgtaatcccagcacttggggaggctgaggcaggtggattatgaggtcaggaaatcgagaccatcctggctaacacggtgaaaccccgtctctactaaaaatacaaaaaaaaaaaaaaaaattagtcgggcgtggtggcgggcgcctgtagtcccagctactcgggaggctgaggcaggagaatggcgtgaacctgggaggtggagcttgcagtgagccgagattgcgccactgcactccaacctgggcaacagagcgagactccgtctcaaaaaaaaaaaaaaggaaaattgggactaaaataatggctgagagaggtgagcaatggagatttgaaataaccattttgaggaacatcaacaaacctgaccagaaatacagaaattgccaaggagttctgaaggtccaggtgaggtcagagacaacttttagtggtgtcaatctgcataattataactttttccagtggtgctagtagcttgggtgtgggaactgcaataaattggattagtctacgtttgttgatttgcagcttgaggttaatgaaaaaataagctagcaaaaatctatcctgaatatgaaaagaaatgaagccacaaggaggatgagatgagaaaaaggagtagaaggattggagttctccttgcaagccaatgaaaaggctacatatcctgaagttggaagaatcctgcccttgtttttatccacagggagaggaaaattctttcctgtcaggctgcagatatttaacagggctttgtgactgattagataacaggaaagaagtttcagtctaggatgactcctactgttctgatattaaaacctactgggaacatagttaataattgatgataaattggcctccagtgagcatttttttttctgaaagggaaaggcagagggtgtgatgaggaagcatggaggcaggatgagatttggaaatgttgaatttgaggttggataggagagtatgtaggtaaagatggctgtttataccactggaaacagggacatggaatataagaggtcagatacaaagatcagcttgggattcagtgatataataatagcctctattgattgttcattgttatgaagaagactgagcagtttatattgtcatttatcctctcatcaaccctttgaggcaggtattaagccattttacagatgaagaagtaggattagacacatgcccagggccacgcagctagtaattgttagaaacaagattaggaactagatctctccgattccaaatccatgcccttctaagctctactatattttaggtcaccagcttctggctcttgattgatacctgacgtgttatagagcttctcagatgcaaataaccgaaacaaaacaaaaatctttcaaatgagcttaagcaaaccagaacaaaatgtattggtccttacctatgggtctgctgattgactggcagagttggaaccaagggctcaaacaatattatcaaaacttgatctctcagcttttcttttctatattagttattctcttgtaagctccctgatatgacaacaagatggccctaatagtttcagcattacatcatggagatacatacagaaagagagctgctctttaccaagggctttgacaaaaatcctggagttgcctctgattggcttaggccctttgcccatttctgaaccaacttctggccaggcttgagccacatgtccaccctggagggtagagagtgaacctcacctaggggtgagaactgaggactacaggtcaggctttcccaagtaaatgaggcacctggaaagagaagaaggggaatggatgccaggcaaacaaaagctgcttgtccacacgtggacagggatgaaaaatctcacctgtgactgcttgaggatgaagataaagattatgagactgtcagtaatgatgaaaataagtgacatttgttagatgcttactaggtaccaggtgctatgctagtcttttacatgtattctattgtttatcctcaccataggtttttgaagtgtatactgtcattatttccaaatacagctaggaagtggtagagctgagatttgaattcaggctggacagctccatacctcaccctctctattaccaccataacattttacttgtaattttctcattgtagttttcacattttgtctagttacactggttgacagcatatagtgaatcagacagacctgggccaccaatttttctacatagtatgcttaataaataattgttaatatgacttaaatagcatttactttaagtattatagtggaaaatttttaaaattaagttcttagtttttctcttaaaatgttttgtgctttatttatttttattttattttattttattttttgagacagagtctcgctctgtcgcccaggctggagtgcagtggcgcgatctcggctaactgcaagctccacctcccaggttcacgccattctcctgcctcagcctcccaagtagctgggactacaggcgcccaccaccacatccggctaattttttgtatttttagtagagacggagtttcaccatgttagccaggatggtcttgatctcctgacctcgtgatccgcccgcctaggcctcccaaagcgctgggattacaggcgtgagccaccgcgcccagcctgtgctttatattttaatcttataagtggctttttatgtttagccactctggtcctagaactcttttgtttttttaaacttcttataccatacttgaatatgtaaaattctagttggattatttcatttttagtatatctgtagagattatggaaatatttttgttaatctttgtttagtctttgtaataatagtttcaaaatcttatctagtatttctataaacgcttttttataaaaagctaatagtgtgtttttaaggcttgtattttcaaaataatttattctgaggttgtcctgtttacttattcaaattggttattcacaaaaataaaaagatagtctcatgtgctcttatttttaagatgcgtattttaagcattaaaaccatatgttttgtaacagagtttgagtttttagactaataaaagttaccgagtaccattttattttggttttcatgatttggggctctgcggtgccaattatatttttttaatcctgtctgaaatgtctgatctgtgtcgtcataaaggaagcagtgcaggattggaaatcaggagacccctttttgtcctttgggattcccctctctaaagagtttgggccagacctttatgatcttttccacttttaaaattctagtgtttttattttaaatctctgctagatcagaagcactgccttatggatgtatagtcttagagctagattggaagatagcatagtccaggttccttattttaaagatataccagctgggcatggtggctcacacctgtaatcccaggacttggggaggccaagatgggaggatcacttgagcccatgagtttgagaccagcctgggcaacagaatgagttccctgtctcacacacacacacacacacacacacacacacacacacacacaaaaaaaaaacagaatgagttccctgtctcacacacacacgcgtcggtcgtggtgaatcagttcctgtctacacgcacactagccgggcatggtggcttgcgtctgtagtcccagctactcaggagactggggcaggagtattgcttgagctcaggagtttgacgttgcggtgagctatgatcacgccactgatctccagcctgggggacagagaccttgtctcttaaaaaaaaaaaaaattaataatagtaaagataatccaggcccaaatgatagcgtctaagatctcaccatcatttagaagtagtggagcaaggacaggcatttctgcctgtgctgccttatgctcttctttcctcaaaacggtattagcaacttgaagacagacaacattcatttatttgattaaaggaacatttattgaatcgcttcaatctatcaggcattttactaggcatgtggttagctgcaaagatgtgtacatgagggaatgtgcatatatggaggcccaaaactggaatatagagtccaacaaccttgggttcacagtctatctgaccacttaggagcatgacctcagttaagttagccattctaagccgcatttctttgtctacaaaatgagaataatagtagtagacatttacacagttgtggtgaggattgagactataaagattaaacttagcatagtacgtggcacatagtagactctcttagagtttatgaaagaaggaaggaattaagacttatggaacattttcctgtattgtcttatttgattcatacccctgtgaggtagatagtgataccctaatttttcaagtgaggaaacagcgctgaaggcttgggacttccccaaggtccacagccattagtcatacctaccatacacattatttttaaaaagtgcaccagacactgttttaagcatttttatgtactagtttattagctttgcatgtggtatactattgttattttcacttaacagacaagggtagttaggtacagagaagttgaataatttgcccaaagtaacacagtcagtaagtggcagagtcgtgtgcttcatgtgcaggaaatctggcttcagagtcccactgttcttttgttgttgttgttgtttgtttgtttgtttgttttcagagagcatcttgctgtattgccaggctggagtacagtggcgctatctcagttcactgcaacctctgcctcccgggttcaagtgatcctcctgcctcagcctcccaagtagctggggctacaggcgcttgccaccacacccagctgattttttgtatttgtagtagagatggggtttcaccatgttgggcaggatggtctcaatctcttgacctcgtgacccgcctgcctcggccccccaaagtgctgggattacaggcgtgagccaccgcacccggtcagagccccactgttcttaatctttgtgttcttccttttacttcatgctctcttttgtgaaggtgaaaagcagttttacaaactagaaggtgctacataagatgtggtatatttatctgacttggtccctgtactccagagattacagtccatgaggaatgtgtcttctccaggctaaacctactcatttattgccactgttactcgctggatattgctgtcactattttggccacttttctttaaaaaaaaattttttttcattttgtcaacgttcgccctctaatgtgtccccagaaatggatacaagcttcaaagatctctattctgccaagctgtcttaccctcattttatagtttactctgcaagatgagaataaaacctgccttccagggattgtaaagattaagtgaaagaataaatgtaaagttattaacacatagtaatttgtcagtaaatgctgctggttattacttctgtatagtatggttgatttttgccattttgaaagtaggatttatttttaactttattagaattcatcatgttgattcaattgagatcacattgaatcttctttcttttatttgtgatattggctacttttcccagctttgtatgagctgtatattttcctattgagaaaggttacattaataagattcctttatttgtgtgactcaaaatcattgataaaaatatagactagctaggctgggcgcggtggctcacgcctgtaatcctagcattttgggaggctgaggtgggcagatcgcctgaggttgggagtttgagaccagtctggccaacatggtgaaatcctgtctctattaaaaatataaaaattagctgggcgtggtggtgggcgcctgtagtcccagctgcttgggaggctgaggcaggagaatcgcttgaactcaggaggcggaggttgaagtgagctgagatcacgccattgcacttcagcctgggcgacagagagagacgccgtctcaaaacaacaacaacaacaacaaaaaaccaaaaaattaggtaggcatggtggtgcatgcctgtaatcccagctacttgggaggctgcggcaggggaattgtttgaaccagggaggtagaggttgcagtagccaagatcacgccactgccctccagcctgggcgacagagtgagactgagacagacagagagcgagacagagacagacactagctacaggctagagatagtagaacctcctggcaggctggcagagaggcctggatgtaggattcatagagaaactaactattaatgttagtttgcccagctcacatttcaccgtcttatcaaccacatatgtgagaatatttttcaagattttaaaaaatgtatctagttggttcttccctcttaattttcttacagttctctcaatttaattacaaatgtgaggcctccatcctctgtccttagacttcttgcaacattctctttaaattagtcatatcctttagcagtggtactcaatttttgttttatggcccatcaatcactttgcttagagtcactgggttctaacaccctctacaaccaaaataaacttcctcttttgtcaacaagacatttagatgtaatagtgtatagcaatctgtaaagatctgcctacagtagatttacatacaatgatattgatcagatgagcagggtagatcacttaacaggttcagcaaacattgtgacataaagattaagcctgggccaccagaaaactgtggatcaaagaaacaggtgactgaagaataggtgagaggcagaagagtggtatagatggatgttctggtgggtggtgggaacaagcatttgagagagagattggatattggtagttactgacagtatgcctgacagatattgatgggatgtaaggatatagagaacttgacttcttaatagttgttatgaaaatcttgtactcagtctgtttttctaaaccactcactaggtatacttaaacatccttaaaaataagttgcggccgggtgtggtggctcacgcctataatcccagcactttgggaggccgaggcgggcagatcatgaggtcaggagatcgagaccatcctggctaacacggcgaaaccccgtctctactaaaaatacaaaaaattagccggacgtggtggcaggcacctgtagtcccagctactcgggaggctgaggcaggagaatggcatgaacccgggaggtggagcttgcagtgagccgagatcaagccactgcactccagcctgggcgacagagcgagacgccgtcacaaaaaaaaaaaaaaaaattaaaaaaataggttgcatctagggccaaaataaaaacacatggtactgaatgaaaaccatctgtaggcataatttagtattctgtctttatttaattaggggggtgtgtgtgtgtgtgtgtgtatacatatatagcatgccggtgttattttgacatctcatgcaaatggcaagttgtcaaacttcaatttttttttttttgactagccacaggggctcacacctgtagtctcagtgctttgggaggctgaggcaggaggattgcgtgaggccaggagtttgagaccaccctgggcaacatagcgagacctcatctgtacaaaacattttaaaaaattagctgggtgtgatggtgcacacctgtagagctgttcaggaggctgaggcaggaggattactcccactcaggagtttgaggttgtagtgagctatgatccaagccactgcgccctagcctaagtgacagaatgagaccttgtgtctaaaatatatgtatatatatttttacaagctagcagtacttctatcaatctttagcaatggatggtaaaacccaccttctgttttaaaattgtattaaagatgtttatgttactcttctttatctgtctaatctatcatctctgttctctcaaggtaaatcattaattgatttattcagtagatatttgagtgcctgtgtttggcactaggagtacaagaataaataagagctggttcatcctctgttggagtctacagtctggttggggaaacccagaaaaaaaaatgagtgtgtttaggtgtggcaatatataaataattaagtaacttttctaagaatgatgtgaaaaaacaaataacattaaactaattcaaagtgataaaagtagaatgaggttaatgttagatgaaacagactcatcattattttctaagactggatcttgtccttacattaaccacactctcccgcagtggtatggatgcaaagattaaacacttcagctcttaaaacaagactagataaaattatttgtaaaatggagatagtcatttctctgaatacctcatggagttgttgcagaattgaaatgagataattatttgtaaatgctgtgaactagagttctatacaaatagaacttgtactctgatgaaagttgtgacttgaatctttgtccatcatgccacaaaaaaacttttcagaagtgtttggttatctgcctacaaagggagttacgctattattgaaaaaaaaaaccagccgggcatggtggttcgtgcctgtaattccagcactttgggaggccaaggcaggcagatcacttgagtccagaagtccgaggccagctgggcaacatagtaagtaagaccctgtctctataaaaaatttaaaaattagctagtctactcaggaggctgaggcaggagcccaggaggctgaggctgcattgagccatgatcacgccactgcactccagcaacagagcaagaccgtgtctcaggaaaacaaaaatagaaaaagaaaaaaatcagctcctttttattgcagttactgaattcttaagagcctgatttacatgttttctggccagtcttagcaacttactgctttatagctgtactacaaaaatggtgccactcagtcacctaccgaagtgaatgaaaacctctagtctgaatgtgtcacttctttgtttaaacctcttcagtggctccctgttacccactaaaacccaagttcatcattggggcttactaagcttttgggaaggggccagagctatgtccagccttacctgtcacattccttgactcacacgtcaggttcacccttgtttgcagtttacacagcatgtgtctacacacacaccatgaccttttctcttcctggaatatgccccctctccttccttacctggctaattcatactctttcaaaactcatttttcagatagtccttcctgatcccaaccttctccccagtgaagtagtcagcgcatggactggtcattttaattgtcatctgtgttggaatgatcagttttcctctctgttctactcacacttcctagcactatgccttacacataccctaactgaacatgttcaaaactgaactcctgatctctcccattgtccagactcaggctgcaccatatgctgtcttcatctgtttatggtaattacattttccctattgcttaaaccaaaaccttagagtcatcttcttttatatctcataccagtctttctggacatcttgctttattctgcctttaagatagtatgagtatcccagcacttcttaccacctccattgctaccactgtggtccaagtgatcgttgtaccacacctgatttatgcggtagccttctaactactcttctgccttccactcttgccagccttcagtctattttgcacatcaggacttggcagactttttatgtcaagggccagatggtaaaaaatttaggttttgtggcctgcacggtctctgtcatagctgctagaccggagttggggcacaaaagcagccatagagaatatgtaattgaatgaatgtggttgcattccaatacagctttacttataaaaacaggcagtgggctgtggtctgccagcccctgctctacatggcaaccagactacccagtgccttccggtgacttaatctttatagtgttctctaaaaccctccatgatgtgcgtccccaaccccttacctgtctgacttcatcttacgctgttgtctgctttcctccctcctctccagtcacactgaccctctttttcctcagatatgccaggcccattgccacctgattctttgcaccatttattccttctgcctggaacattcatttcttcttaaatgtcaacttctcagtcaggcctacctgaccaaccaccctataaataattacattctagcattatattccctattgcgtgtttttttttttcttcgtaatgcttgtcttctgccatttcttatattatgctatatattgacttaattttttctctttcttttcctgctagaataaatgttccctgaaggcagtaactttgtatcttttctattaagtagtgtatccccaagatctagaacagtgcctgacgtatagtaggtgctcagaaaatatttgttgaatgaacacatagtgtatatttttagggtttaattttttttaaatgagttctttctctctcgccagcaccatatcctttctgtttcacactcttactgttgctctaagctgccctgtcctttccattctcactcccctttattctgactctcatctattagcagtgtgtccataaccttttatttcgtggcatctgggccatcctctacaagtagattgagtgatgtttgtaaaatggaaaaatgattttattattcaaaactctttatttttgattttttgccaattacaatgaagtgcttgtttaaagtacaggatctcttatgaaggaataattgtcaagaaaaaaaagtacgggatctcaggcctcatgccatacctgataagtcataatttcaagcagagggcataagaatcatcataatttaggaagtaacccaagcgattcttactgaacacagttggccaacactggcctgtaaggtaaagttccccagtgagtcagtgagagcctttttgagctgcccctgcctgtctgtcctgccccatccctattgctccacactgcacttcatcttccaacagtttttctatttgcatttctctcaaggcaccatattgattctgtttttgcaaatattcttttccctgtacagaacagaatcttctactctggaaaacttctatttttgtctttcaaaattctgcacgtttgtcactttctctataaagtcttttctgatccccattcccgtgacaaagttaattatgtctttgctgtctgggtactttgtgtaagtaagactctgttctggtgtttattacactgtactgtgtgcctttgcataactgtttgcctgttgtgacctgacctgagccagtagttgtttacgggtattaggtttttattgagaggtactgctgttctttggaggctacagttaaatgagtgttacaaatctcttcccccagaaccgagcttctaaatggcatgttactgtgaaagcaaaactcacactgagttctgccacacacaaaaaaaatttattaggaagcaagcacaaaaatactgttttattaggtggataaaattcctactctctatgcttttagaacatctgacaagcacctttttttttttttttttttttttttttttgagacagagtttcgctctgttgcccaggctggaatgcagtggtgcgatgtcggctcactgcaccctccacctcccaggttcaagcgattctcctgcctcagcctcccgagtagctgggattacaggcgtgtgccaccccacctgggtgatttttgtatttttagtaaagatggggtttcaccatgttggccaggctggtctcaaacttctgacctcagatgatccacctgcctcggcctcccaaggtgctgggattaccggcttgagccaccatgcccggcctgccaagcaccttttatggaaggtttatttaaggcaaaaatgctagtgtgcttttaggattcagctgaacctaattggaatcaaataacagaattcctttatggggaactaacagaaccagcaggagtcataaggctcagggtacagtccctaatagtaggccattagattaactagattcatgtatatgttcatgtaagagcagtggtccctatacagtgtgtagccataacacctttcttgagtaccattcttctctaatactgtcataatttctaatatccactatgttaattactaaattctctggctttgagatgagataaggcttcttgagttgtctcactggagtagggtttttgattacaagctttcctcatttactgatgattatttatatccagtcttgggcttgcatgttaactaagtgctccaggatgaatgtcaggaacctctcactcatgtcctctagtccattaaaacaaataataattacactgtttgtgccaaaataacttaaggaatttaaatcgtaactcttctagaccctggaattgaaacagatgttttacttttaatctctgtatcctcatgcctagtgcagtacctgctcagtgagcctcaagaagtgccagaatgtatgtttgtaatgtcaagcagctaagtgttttgttctgtttgtatttttgtttttaatgccgaattgcagactcttccaacgaattatattaataatatagcaagtttgccatagctgtcagaatatctgtcttaacagtgatacttccttgcatgggctagaatgaggttgtataattccctgggtggggatcaagctgagacctgctcaggatccccagtctccttgtggagagaggttgctctgtcttcctcatgaagtttgcagtgggagtggtgtgtgtgatataaatacagagccctgcttgggaatctaagaaagagttgtgcagtgctggtaagattatagctgaggttaacaaattgtagatctctgttctgacagcagagctagacagctcaaaatataatgtgtttcaccagatgaatttcttatttgtaaagcataactttatcaattcttcactaaaagggaaatgaaagctcagagagtactaaggcatcatgacatatctctagattatactgtcgggagcatcatacttaagttgatttttaagtgtatatttaagtttttttaatcatgggctagaattagagcctaataaggaaagtagtttggtgttagattattaaacaattcataattcttgggccacttggagagtgatttggatcaatgctatttcttcttcaataatctttcattgtttttctgtatttttcatatttctatgaacatgggaagaatcttggatttttaaaaactttacattgataattaatataattatattctgccttcctgtaccgataataaaaactttgtattaacatactcttccacacaagcagagtaaaaaggttgaaattgttgttgtgtcatatgacagcggttaacaaccaaagagctcttaaaaatcagtagggggccaggtgtggtggctcacacctgtaatcccagtactttgtgaggccagagtgggaggatcacttgagaccagaagttcaagaccagcctgaacaacgtagtgagagcccatctctagaaaacattaaaaaattagccaggtgtggtagcgtgtacctgtactcccagctacttgggaggattgcttgatcccagatgttcaaagttgcagtgaaccatgatcacgccactgcactccagcctgggtgacagagtgagaccctgtctctaaaataataataataactcagtagggaaaagattaacccagtagaaaagtggataaaggatatgagcaagcagttgaagaattaaatggccaataaaatatgaaaaatgctgacttaaaaatataagatgtaattaaaacattagtaagataaatgttacctatcaaattgagctgttttcaaagattaaaacttactatgctgggttggcaaatggttaaaaagatgtgtgcactcatacaaagccagtaggaatataagctcatgcaataattctggagaacatttcagcaatcagaaagctttaagacctaataatttcacttatagtaatttaattttaggaaaatatcaaggatttacaaagattaagctccaaaactattgttgatcacaatattattataatagcatttttctaatttttaaggaaactatatgcccttatatgtctttttaaaatatatatatacctatcatttacacttagaaatgaattagtcaaaaaattagtcagaaatcatttataataagtcagcttttgaccactgagttgtttactgtgatcaagaaagcagcaaggcttaaggagttcttattcttttttttttttttttttttgagacggagtctcgctctgtcgcccaggcttgagtgcagtggcgcgatctccgctcactgcaagctccgcctcccgggttcacgccattcaaggagttcttattctaaatgactttatttcatgacaatctgttctctgttctcttctctctgtactcccttggcaatctgtggcaggcacacggcttcagctatcccatgcgaagatggctcctaaatttacatttccagtcatgacttttttttggagttccacacaagtttccaactgccctttgaacatccccacctggatggccttccagcatgacctgttttcttccgtatttgaactagatttttgtagacccccaaggtagtgatagtgatgtgtatgtgtgctttggaagtgggcagggaagagacttaaaaagatttaactgtagaactgaaaaataccatgtgcagtacagcaggttcttgaataacattattctgttcagtgtcgttttgttataatgttgatgagggataaagaatcaattcctggccgaggccaatgtctgtgtggagcatgcaagttctccccatgtctgcgaagttttcttcaggtgctccagtttcctcccacatcccaatgtgtgcatctttgggatgtggactgacgtatctgttatcttagtgtgagtgaatatgggtgtgtgtgagtgcaccttgcagtagaatggcgtcctgcccaaggctggctcccatctcgtgctttgagctcccaggataggccccagccacctgcaaccctaaaactggactaatggcataaataattaccttgtttttattaatctttcttaaatgtgtatatagctcacatttatttcaaggtttaccattagaagtgttttggtctttatttagaagtttggcaatgttttatgaccacaaatatgctgtagaaacttaagttggtttcattatacattgtttcacataaagtttccaagaacctatcgaggctattagtgaggacttactgtacatcttgacatgggagaattgggcattaggcatgagcatgtgccactgcagcaggtggtgggccgcttacgagtctggattaccaatttcatctgaactcttgggtggactatatacatgccttactggagcaaggaattgaagaagaatacagaaggaagttgtttttctctgcctcagttcatatcctgcctctgccatttagagtctctgaccttcggcaatttttttcttttcactccagtttagttttctggtctctaaaatggggggagaaattgtgcctacctaaggtttgctgtaaagaatgaccgaggtaatccatgcctggcctataagtgattagtaaatgttagctgtcagcctctacaaaaggcatagtgctatgtcaaagcatagtgctttgataatatagtttaataggataaattttcagatagtaaaccttttcccttcattcagggtaaaaataatagttctgtaacccatcaaagtttagttctctaagctttgtatccctgttttaaaataattcagctcaaaaaagaaaaataagtttcctggttcagcttcatattgaagccttctaatgctagaaataaatgtctctagattcctcagaggcattgcggacctcttccttccttttattctcagagtgaaaaacaaatttatgctgtttcctatcttaagaacattctcaatcagccaggcacggtgtctcacgcctgtagtcctagcactttgggaggccgaggcaggcagattgcttgagcccaggaggggaagaccagcgtgggcaacgtcgtgagaccttgtctctgaaaacgtaaaaaagaacatccttaatcatatatattttcatatcagaaaagaaaaaaatagtattgttttgttttgtttatgtataaataggtttttctcgatgggaaattgaaacatttaaagttggtgtctctataaggtggcaaattaggaatttacctcagaattatatagtggtggattgcattgtttctttttcaggctttctggtttatagggttatgttggtatttttcgtgttattctttttacaattataatcatgaactgctgcctttcctggggctggtattggcaagttaattgggttggcagatccatgcaggccctgtggagcactcatcccctctcccttcttcctttctcctcatttttcagtattcctgtcaccagagcagagcacaagggacctagggaatgccagataagactaaagtggtaatggccacttttaaataatacatttagatggtgataattgagctatactgggaattatagaacttaacacaattacattaaatttattaaaacttttcttcaaaacgtgagatttaaaacttttctttactctgccttttattttttcaaagaatcctcacttggaattcaaatactgtataggaaacagctaagcactgcctctagtttaaggttggggttaaaacctgcttgtttggcctcttctcatatcacttcattcccaattagtcccctacccctagatacctccctagggctccagggctctaaggaaagagtttagaagtgaataatacaaacagatccccggttgggggataatcctggtgccctcagttttgttctattctgggatgtctggctcattttgacagttatcgataaactcctctcctacccgatgcttgtaattaaaactgctctttcacctagtgtttccattttcatgtacagtgactccattcatttacttacctaggctgaaaaccccgtagtcattcttgactcttcttactctccactcattagcaaatcatgttggttttctgccttcagaatacaccccactttgctactctgggctcagcctctttggtttcttgcccggaaactttaatagctaacttagtcttctcttttcactctttgcttcctgcagtctagtacagtggttaattccatgggttctggaaccagattccctgtcatgtgactttgcgaatactaattagcctttctaaacctcagtttagaggaatgaggatgagaacagtgatactgtttacctcacatggttgtgtcagacaacttgttatgcacaaattacttagataggacatggcaaacagtaaatgtcccataaatgttaggtggtaagagatattgaggttgttgtggttgtttttattcatacagacttgaaactgatattctcaaaacattagtcagatacattctctgttggcttcctggcccttcttagcacaatatccaaaggccttcctgtggcttaccaagccctgcagctctaggttacctggttcctctctgatcacattggcccgtgctcgctgtgttccagccacactggcctgctgctctttcctgccttgttcagcctttgagcactcattttccctctgccacattgctctctcttcagagatttgcccaacttgccgctcccttcatttaagtctaaacccaaatgtcaaccactgttcaagaatatcatgtcatctttctctatatacctaatttttttcatatcttaagaaaatacaacttttcactacctaacattacattatatatctgtttattggctaattatgctgttagaccagatttcatagtacaatagtcccctcttatctgagggcaataccttccgagaccaagtggatgcctgaaactgtggatagtaccaaatcctaatatactatattttttcctgtacatacatacctataataaagcttaatttataaagtaagagattaacaacaacagtaaaataggacaattataacagtatgccagcatcgctactcttgcactttggagctgttattaaataaaataaggtttccttgaacacaagtaccacgacgattgctctgatgacctagaaggctactaaatgactaatgggtggatagcatctacagtgtggatatgctggacaaagggatgattcatcccaggcaaaacggggcaggactgcaaggtatttcagtgcactactcagaatggtgtgcaatttataaactgtttatttctggaattttctattaaattttttggactaagttgaccaaaggtaactgaaatcacagaaagcaaaacttcttataaggagggactatgtaaatgagtgcaagggaccttttctctttggttcatcgttttagccccagtgcctttcatatacatagtcgatgttcaagaggtatttgttaaatggatatatgggatgtgatggggtgagtgactgacaaatattttccccttccttctttacacaagagatgctgaagttaccagatagttggaaaggcccaaattaacttttttgagatgtagagttcaggtttcccccttctttcccatgaataacaatatattgtgtaattcatcataattacttcagttaaccacaaatggagtaattgcattgttaaattagtaccctcttacagttactattcaaggtaaacttctttcctgggtagctagtgacaagaaaatcatttgggctcatcatttattgagcacttaaacccactaagcccatgccacactcctggttgttaccaacctccagtgctgaaagaaggaacttgttaagtctgtctggaatcaggaaaaacagagacatatataatgttctccaaaaattctgctgcttataaagagcagtgaattcagagtgtctagggaaacaggatttttaaataaggatttaggtttaagatgcctcttagtttcttagggatgggaagtgagttttaaaaattagcatttttcttttaatatgatagtagaacaattcggttactgtttgataactttatactaattcattgactttattatatgaagaaataaaggacttcaagaatagctcataacaaaccgggtggcgtggtggctcaagcctgtaattccagcactttgggaggctgaggcaggaggatcacttgaggtcaggagtttaagaccagcttggccaacatggtgaaaccctgtatctactaaaaatacaaaaattagccgggcctggcagcatgcacctgtaatcccagctactcgggaggccgaggcaggagaatcgcttgaacctggaaggtggaggcagtgagctgagatcgtgccactgcactctagcctggtcaacagagcaagactctgtaaaaaaacaaacaaaaacaagaatagctcataaccttgaacgtctttgtttgttttcttcataattcctgagaattttttaaaaaataccattaccaatttcagttaattatcatgtacacctagaatatggaagttattttgtgctttttattttgggcctcttttctacctttaagcttaacatccaacagtcttctgaaccatatcttgttataatctgagcaaataattttctttctgattgaaagagggtaaacataagctaatttgtttagtcctttttttaaaaaaaaatcactgacactaaatgagttaatgtttggagtttagttgacctcctaaattatccctattacaacatagtaagacaccatatctacaaaaaatacaaaaattaaccagcctggtgacacgtgcttatagtcctagctacttaggaggctgaggtgggagaatcacctgagcccaggaggttgaggccgcagtgagccatgattgcatcactgcactcgaacctgagcaacagagccagaccctgtctcaaaaaaaaaaaaaattggtaccattcagagacagtgtcagatggggtgttgactgggttggttcacctatcagatggtaaagtaggtgttctgaggtgagctcaaggaagattgaaatctcccatggagcaggacaaaaacgtacttgatcttgattatctgtatttataaagattgtcaaagtaggaccaagaaatttttctgatctttggagttatcactgtgaagcagaattcaccagtccttgttcatcaacctatcttgtgttccctataaatgttaatgtagaatagccttatcttatctacaaaatattatttttattagaagaatctaagtgtaaatcagtagccaaaaatcagagatctgatttattagctgttctctctttttatttatacatggactttaataatcattattatcattattacaggccatggttgcttgttatccgggcaatggaacgggttatgtacgtcatgttgataatccaaatggagatggaagatgtgtgacatgtatatattatcttaataaagactgggatgccaaggtatgcaacttaattgagcatttatttttttcttacaggtgtctttttctcaaaagcattaagtttcatacttctgataagactgtcacagacacagttaaaaattttcctcttaaatttgtttcagtctcaggtattaggagtggatttttgtaaaatgaaacaaatactactctatgttatacaacatgatacctgtagttaacaacgtagtgttgtgcacttaaaaatttaagagggtagactccatgttcagtgttctaaacacacacacatacacacacacacacacacacacacacgcacacacgaggttaggggaagggaaacggaactttgagaggtgatggatatgtttattaccttggttgtggtgtgtcatgagggtgtgcgtatatatccaaactcatcaaattgtaaatgttaaagatatgcatttttgtatatcagttatacctcaaaaccatataaaaaagtactgatatatcttaaaaagtggattcatttattttcagatgttagagcacttatctaaaatctaacttttttagaaaggtgacctttattaaaatattttccttttaatagtttttagaaaaacatttctgagaacagttgttttataatggcttttgggggagattatctatggataattgttaaggattatttgctatgttattcttggcatttttgtaaaaatattatatggcattgagttgtttaattgaatattggaggcaggattcagtctttccctgattattaaaaaactggaagtttatcagtactgacaagccctgtaaaaccaattagaatgtacaatatatttaatctctcttgttttaaatatatatttccttaatattagcctgagtctcattaaatttaaatgatttttaaaaaatatgtcatatattactacactagagactgtacagactaattttttggttgattttttaaaatcttaagtataacattcaaatagaaaagtggcttgtatagttcagtggattttcacaaagtgaacatacctgtgtagccagggtgcctttttttgttgtttttaagtcaaataacctttaaaaaacctctttctctgcatcccccaaaacacacaaatggaaactgcctgagtcttaaatgtgcaaaaacctaatcctgccctaaaaagtgttttaagtttagaatatgctcacagtgcttcactaatctttctaaaacacactgatttaaagagttttctctgccctagtccaggttcaaaatggagctgacctttctgctgagtatatattgaggcatgtcaacaagcatggtttttctgttacagctttcaaagtttgaagtagagaaataaattttgtaattgaatttgagcccaaggcacaaaacagatgggtgtaactttagttaaaatttaaaaattgactttttttcagattttgtgaatagctagaaagctagaactgtgtttcatcagcttctaacttctagattttgttaggctttttctaggctgatcttataatttctataatacttagtcagggtcattaatgtgtaggttttaaattaggacataggcagagaaacgtccctagtgtttttgtgtgtagaatagaaattttccatgctagattgcactgaatatgtagtgtgtcagttgttctggatgctagggatgtagcagaaacggaattagccctggcagagcttaggatctattggaggatacagatcagaaagattgacagttacagatagttatgcaaagtgtcaagacagattgctatggagcacacaggagggccacctaattcagaggaggaagagtggaagtgtcaagtagccatttcacttaaaacattttcagcaggtcacctgtggtactcccaatgacttgagtcaaagggaagggagcaggaaaaaaggaaagaagacatgttctcagtttggaggttctttagatgtttgcatagtagcctggggaatcactctgaacaacactggaacctgaggaaggttggcaagggtatcaaagtagctagaatttaacttacctgacagtgagcctgataaaccttttctttaactatagattctaggtttaggctcaaacgccatgttgtcctgaccaggtgttagagtttctttaaattttaagagtctacctgcttaggagtgtagttattcaagagtaaggagctacttggttggttgggttttgcctatccccagatcgtaaaccccgcaaggacaaagtctgtctgcattattccctactctgcacccagagcccaccacagttcccagtgcgatttgatgcctagttggtgtttaggtaaataataatcctttatgggtagaatcaagtttcacaagcaggtagtcatctgtgcatcaggcccagtctggaaagggagagccacaggttctaatgaactatatgctgatggtgatggtgacgacgacaataatgatggtcataataaatgatgacactttctactgatatactgaattatttaagtaagaggtatttgtgactatcctattgtttattgaattttaaagtatggtaaactatttgacataatttatttctaataataattttgtcaaaatttcttgaaatctatctatttgaagggtgggttaagcaaatcattaacatacaaaaataaacgtttagtagttttaaaagctttcaagcatcattttaagacttttaaattcagataacattcttgtgtttcatcagatatttataaaaatccctaaaatggctggggacagtggctcacacctgtaataccagcactttgggaggccgaggtgggcagatcacctgaggtcaggagttcgagtccagcctggccaacatggtgaaaacccatctctactaaaaatgcaaaaattagctggacatggtggcgcatgcctgtaatcccagctactcgcgatgctgagacaggagaattgcttgaacctaggaggcggaggttgcagtgagctgagattgtgccactgcactccagcctgggtgacagcgagactccatctcaataaataaataaatatccctaaaataagaactaaatttgtccttgcatcagtgcatatacttttaaaattgcagctcatcttcatactttattgagacgtatttgtgaataatccaattaagacattgaaattgtctctttttttccccctaaatttaatcttgtagcatttttggttactcctgcttacatatttggctcttttcctaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtagtattccttttcagaaaaaattggtttagagtatggtaggacaggagggaatctgtagagtaaacgtgaaagctttctaatgagtattttcctgccaggtacttttcacagtcattttaatttgaataattgtataagatttatgttgcacagtcatctgaattcaaataattatataagactcattaacagttagtactaaatgtgtctttctttgcacagccactctgaagaaagggaagcacaggccttcccatctttctagcactctctccgtgctttgtgcatctcttaactactatccatgctttgatttttgtaagagtattttacttgggagagagaaagatcaagaaggaaaagggttttttaaaaggtggtgagggacaacataggaaaatggatacagagtagaaaaatcagaggtaaccagagagtagaagtgaagagaaaaacagaagaaagaaaagtagagaacaggttaccatgtgtgggagttaatgttagaaaaatgatcctattagctttacaaataatgagcatctgtttcattatactttttctacaaggtatttgcaacctattatatttagtgctttatttcaaatgcttttttaaaaaccatttatcctgactcaattaaaatgctctggctgtgaaaacaagatattgtagacattatcatgaaagtaaatatttgtagaaaaatagcacattaaaaaaaaatacttattttttattatggaaaggtcttggaacattctgatagtgagcttccggcattcatttgctgtatctggcttaggagatgctagggtggcaagaagaggcacaggcttagatgcgctgggtggagagttggctttagtaatgatggttgactctaacgacttgattatcagctgtgccttttttcttcctgccttctgaggtgtgttgcctgcatcctaattcacgtactgagtagcaagctaagcaggttgtagctggagattgtaagaaatcctgaatggaaaccaaagaaagactgtcacatcacatgatgtgcccttttcaatcccatgtctcttcccagtggcatcccagtgctgtctctgccccctgctgcttctgtaaagattttctgacacagtaactgcctcatagaccttcctttttatgaaatcctgagtttggtttggttacgtcctttttagatgaataaataacagatacttgggagtttatagtaaataaatgccagatggcatggaggctaagtgctacaggagttgaggaacgaaggtggtgctacattggagagacgggcaagtgcgctttgaagggagaggctcagctggcctaggtgaggagaggcaaggggtgcagtcgtgttagtaaagttctgggggaaaaggcgtagttgttcaagttaaggcatggaaaatcatgcgacgaaaaggattcttgaagtagaatcctattctgatcttatctagaatgggtgataaggctggaaagttagaatgacataaggtaagttgttgatccagatattagaattctgattgctaagtgactaaaagtttagggcatgggcaaaagatacataaaattatgtatctgagccctttcctatttccaaggccacccaaaagtagaagaagccacatggtaagaaaggtagtggaactctggaaagagcagagtctggtctggaagtcaggagacctccttagacctcagctctgtgattcaccagtggtggggtctgtaaacgtcaggctcccagttgtccaaactcccagactctttacttcaaaatacattatgtgatttttcattctgtcatattactggctgtatgtctgataaatgttgccttttcccctgtgtccactggccacaatccacaatatatttgaactaattgctatattctgcccaggaactggtgatttgtagcgtactttcacttcctatagcgtttatacattttccccattatttgtatcagaaagtatgtcttttgtagtatttaataaactagagatgcctcacttattggtggaatgaaatattctaagtcagattttcagaaaaatgaagtttagacaaagtttaaacacaaaacacagtataattgctttgattaaaatccttaaaaattcttagcataatttaactgtcaaggttataattgtaaacatccatcattactctttgctataatgtagtgatgtccccagagactgttgaaactgttagcctgcaatgccctgagtccttttatctgtttcttttctgttcttttagtacttgtgctattgataatgtgctttttctgtaacagccattcttttacccttttattgtctctctttttttttagagggaggctcactctgtcacctaggctggagtgcagtggcatgatctcggctcactgcaacctccgcctccccgggttcaagcgattctcctgcctctcagcctcctgagtagctagggctacaggcatgtgccaccatgcacggctaattttttttttcttttttttagtagagatggggtttcaccctattggccaggttggtctcgaagtcctgacttcatgatccacccacttcggcctcccgaagtgctgggattacaggcgtgagccactgtgcccggcctattgtctctttctgatctgcagttcccttgcaaaaaataagtagttgaaataagtattaagaaagtcacaaaaactcatcaacttcagacatcaattttagtctcccctggttactgtataaataagctgttaaatttatcctttgatatcattccagtttaggcataattttggcattacaagttttaatataccattgcagcaaaataccactttttccccgcagtgtgatcattcttatcctattctaaattttcttttaggtacgcaataactgtttggtattttgatgcagatgagagagcacgagctaaagtaaaatatctaacaggtaaacgtcatttggggccaggatatattggtacagaaataccctgcaatcaggtgatgctttcaggaaactcaagcatagtctttgttaacaccatgaatacttactttttgttttttatcagatttcttatttgcctcattttttaagaagacataagtcatcttcactgttatctttaaccaaaaaaattgtcaaaggatgtggaaaatttgaggcaaagaagtctgagtaaattattcacatacaaactgagttttctgtgattatccttttcagtcaaaggccacttaactctaggtaacggccatatggtttcctctcattcactccttaaattaataccctttccttttcaaatggatgtgctctaaacagtactctaggtcttccatgttaaatgtagacatgaagaaaattaatacaaagaattatgaattcaaatgccaaaatcagtaaatgacacagacatgtagattccatatctgctaatggtgtacataggtcagcactcttgtactgaacctgaagatcctttaattatgccagttccccttctcttccacttatggactgcctctccaagagcagggggtctgtttcccatctgatggaccacttaccttcttttctttaactctactttctatctccaaaaatccactgagtattcacattactgattagctgtgttttccagagccattgctaatcgcacgtcgaccttacataaaaatggaatattcatgcattttctatgtatttttaaagccattatttgtggcacaagctcagtgtgctttcagagacactgaacactctgttgaagaaactcaaatggcttttaaaataaaaagacaaaatcattatctctgtgtagaggatggttttatccttgaaggtttactatttgaaacctcatcacaatagaatgctgagggaagtttttggaagtacaagcgtgatagttctcagatgatgtttgcaaagttgaaatattgtccatactcttaggaattcagtggaatgcagtagcagaagctctctggtgcttagtgaatgaatgaaaattttttttttttttaccttgcaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacatta

SEQ ID NO: 121 - DNA, 9299 bp, Homo sapiens
acgtgcccaccgggcgaggcggggcggggcgtcgcgcgcggtgggggcggggtatggcgcgctgtgcggcgcagggcggctggcacaaacggcggcgccggggccggaggaaaaagctcggtgaggaggtcgcggggcgagaagggagcgggaggagactaagccggagccggggcgccggcgcgaaccgggcggggtgtgggggcgcgcgccggggcctgccggggcgaccccgggaagggggatgtgggtgcggcgcgggggaggggacgcgcgccggttacgttgggtgccggccgttgtgggggttggggtgggggcggggagcgcgcgccgggcggaggccgagtggagggggaggggagggggtccgagcggcccttaggccctgcccctgtcgcctactgcgctcagaaggggcctcagggcctgccccgggttgggggcgttggggtgccctggatgggggcacctttatctctcgtcctgtctccgggtgcgtgcaccctcctccgtcctttcctctgtcgccgcggaccctctccccgagggcccctcccgtcggtcagtctcgggacctcccttccgtctgggcgtgtgtccgcccccggccggcttcctcccgtcgggctcgggtcgaccccaccgtcccgctccgccccgggtcctccctcccagcttccctccggtctatttttctgtctctgggcccctcgttctctttgtttttggactccccagtttcctctgtcttttgacccccccgcccccaccctgactctccctggaacccccacgtttctcgttgtctttctggaacgccgaggcaggtccctcctattttccaaaccccctcctttcccactcctccacaccacccttttctactccagccctccttcttctgtctttggttaccgcgtcccacaacctgcaccacagtcctctgtcttagggtcatctacccagcccctggcctccagcctctccctatcactgcctcttatctgtcagcggactcccgcacctccagattctcagggtcctctccccgacttggcctcaggttttggggggcctctatagtcaagtctgtcctggtcgtcttccccactcctgcccataccatcccggctttcccctgcctgcctgtctctagtttctctcacatccctttttttttttcctttctctagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggtaaggctaggtgggggcctctttggaggggctttgcagcaccctggtttgcagcattcagtgctctgagcacagtgggtttggagacaggcttctgggaggtcacagaaggtttaggcagttcagtggagtgggtatgcttacttgtggggacttgggggggtctttatcctccctacgggccttaatgtgtgcacctgataagctaggagtttgtcctggagccacagtggttcttttttttttttttttttttttcttttctttttttattgatcattcttgggtgtttctcgcagagggggatttggcagggtcacaggacaatagtggagggaaggtcagcagataaacaagtgaacagaggtctctggttttcctaggcagaggaccctgcggccttctgcgtgtttgtgtccctgggtacttgagattagggagtggtgatgactcttaacgagcatgctgccttcaagcatcgccacagtggttcttgactttgccaggaaccctcttaaactcatgagagctgctgacattcacagcgtggaccttggtggggttcatggcctcctggtgtcagtctgtggccccagaccaagcacggggatgtagataggcacacagttcacctggccgttctctgttgctgtctgtccctgtccacatccttccctgtgctcctgtcgtccatccctgtttgctggcccatgtttctagtccatccatcctgtctccaaggcaggagaagcagaagggggagggtggctgtgatgagtgagccctgggctgagggaaggaaaggggtgctgcccgctgggccgagtgcttggccctggactgcattgtgccctgggtccccactgtggcatctgcatcgaggacagtctcctgggggtggtactgggtggctgcctgttggcccaggtggagctcatccccatgtctcccacccttcactgtcccagtccctgccctccattccccctgtcctgtgtgtcacttcctccctacccatgtctgtctcttcctctgcctttatgtgtttgttcttagtccctttttctttttgctttagaacaatagttcttaatggtattttggagcctgggtctttttgagaatctgtcagaggccacagatcctctcttaagacaaatgctcatttgcttggagtttccgggcagttgtcaaggcctcatggcctccagctgcctgttcaggaacctggggtcaggagcccagcacaggacagtggtccatagggcctttccgggctgctgacaggatcattgtcttcatgggtggtgtgggggcctggccttgagtccaaggcttggtgtcctttggacaaggccctgtggggagtgcccactgctcaacacagtgatgcctggctggctgatggcacgggcagtgttgtgccctgcaggcgtgaggctgagctcctgatgtcctctgcctcctcctgcagatcccatcttgggttctgcttctgtgtggctttcctctcaggctggagctggctcagggaccagggctcccccggggccaaggcctgtttcctccccaccccagctggaacttgttctacttccctctccctcccgttacttgatagctgagccagagccggcccctccctgggcttggctcctgtgcgggcgggatcagtggcctccctggctcagcatcttcaccccaggttggctgtcgtcctcgtcagggggagaccagaagggctgagtggcccagatgggacactgctctgagcctcaatttgctgatccacggaatacgaaaaccaggttacatccccagtgagtctggcagtttggggaggggagagtaggagaagatctcttgtgttttggtgcctctggtgcccactttctatgtggttggggacagggccccagcgaggattggggaaggggcgtgtttggacttttttagccctaggtgaccttgattgtcctagggaagtaaggacaggccaggctggactgagaacataggggaggagccctcccctccccagtgagacagcaactccaggctttcccgcttttagatgggccccatctggactctctcctgtactccagagtaaggctgtggggtgctcaggtgggctgcagcagttgccgtggggacatggatcaccagtgtggctagagccagtagaaacgtgcttcttagtcgttctgagtggagctcctgtgtcatccttccttcccccaactccctggttggggacaggtgctccgttgacctgtaggtgggagagagttgactcccactggcagcaagggctaccagaggggaccccagggagagtccagcttgcttggtttgctccttgaagagcagcttggaggtgggacagtcacaggcttctgactggggtgtgtgtgtagtgggggtggggctcttggcaggcagattgtcaccaatagcctttaagtctttggtctcctggccctggtcccacctgtccctcccctaggtgggaggggtggagagcaagtttcctgaggccttcccctgtgagggcaggaagtagatactttccttggggccagaggatgctttcacccccaaggtgtgtatatgtgggggaagggtggggccctaaagagcaggttcctgtttctgtgtgagtcccatgtgcttggtgggaggcgctgtgtgagaatgtacagggcaggaggaaacatagcagggctggggtgcagaggaggcccagagcagtgcactccagtctgcaggtactgcactgggcactggggagaccaacctggccccaggggcttccctgtggctgccttccagggcagtactaggtaaacaggtgcctgtgctgatgccatgttgctaggagtggaacggacaatcagccggagtactcaaggtgacccttggtctctgaatcctgaataacaaagagggtcagaaggaagagtgtcccaggccagtgctgaggccttgtggtggcgatgagctcagcctgttgaggcatggagcagagtgatgggagaggcacatgaggttgggggcctttgaggctgtggttgggaatttgtattttctcaggatggagtgaagacctggagaggaggggctctggctgctgtgtggggatgaattgtgggaagagggtgcagcactggaccccttccctgccacccatccacgtgcatcatcagtgtaatctctgattggattcctaattggggaggtcttgcccatctctagtcagtaactcactgtttctaagcctcctggaccatggcccaattcttctcccagtgaggtggttgctcagagtgccgacccttccatagggagtgagcagtgcaaagaaggtgccccctcctgaaccttgaagtgtagccattagggttttccctggggggccttctcactaattgtactctggtgctgccagagagaaggttgtcagcttcccactgctaggtggcagtagatggtggcagccctctctttccagggcaaggtctggtggatgaggtgcacatggttaatgcagagcagcttaacatccaccacagagggtgagccctgggataatgtgttgggaggcgtcctggggagggtgaggattgaagcagcccagtctgctgtggcgtgcgtgcttggcaagcatcctgttgtggcagtggccactgatgtttgatcgtgaatgtttatcttgggactgtcttgctgggccgggcccataggtgtagctgagcattcgtggggaatggacgccagcagagttgtaccagggcagagaggtcagggcagagaggtcaagacagatggtccgggctggggagaagttgaagggtccttgtgccagtcctcccctttttgtgtgctacctcatcttgccactgcagtgactttgggcagagggtgggacagggaccttttaaaatttttaaatggcatttcagcctgtgctccagttctccatgtggcaggcactgtgctggctgtcttcccagacacttgttatcttgttcacttgttccacaacaacctgtgaaatagctgtgagctccattggatccatggatgaggaacctgagaccaggaagtcacctgcctgatgccacagctcatgtggcagcactgagacttgaaccagggaattgtgtctgcagaagtggctgggccatttcctttacctctcagccacctttctgccagctccctgatgacaaacatcccggggccctggccacagcattgtagggctgggtcaggggagtggcaactgtcaggcagaggaaagaaccctgtagacagagaaaccaagccctgcaatgagtcctgttagatctccaggagttggggctccagaacctcccaagttatgttctcagagagattaattgctaccgctgtaaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggagctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctcgggtacgtaaggcacgttgacaatccccacggcgatgggcgctgcatcacctgtatctattacctgaatcagaactgggacgttaaggtaggggtgagggtgagggtgagggtggcgctggggctagggctggggcgggggtggcgtgcgtccactccattttccactctcagcccagattctggcattctcctgtttctcttctcaacacacagcgggcagtgcgatctgccggctcttcctgggaaatggcacctcctcctctctagcggactgtgtggtgggaactcccctctttccgggaatggtgctgtctgcccagccccacccggccttgtaatgaacactttcccccttttcctgtctttagtagcttcctgcccatctccatggtgatgcagtctctgggttgtcattcactttgagagcccgaggggtgggagggagtgatgcaggcagacgctgcgcctcctagtgggctcccggggcaccgtgggaggcagcggctcctggccgtaccagctagcctcatcctttggcctgcccccaggtgcatggcggcctgctgcagatcttccctgagggccggcccgtggtagccaacatcgagccactctttgaccggttgctcattttctggtctgaccggcggaacccccacgaggtgaagccagcctatgccaccaggtatgacctgtacttctggagacgcacccaggtgctccccctgtgacaatgtcctgtcagagcctcagagtgactagggagcgacgaagtattgagagggggcctaggtgggagcagaaccgggtggctcaaaaggatggccgcctagtgtgtgtggatatggtagctggaattgcagaaaactaatgtccaaccaccctggtctccaggtacgccatcactgtctggtattttgatgccaaggagcgggcagcagccaaagacaagtatcagctaggtacctgcttccctcccttcagtccttcctattctgtgggccctcttgggcctgatgccaccccatccccctcatcagcctcttgttaaatcccaccactcatttttcttcatctctgcccaccttccttagcccactctcctggtaccccaacaggagccccatttcttcctggtcctctccccatctccccaggtttcccttggcttctttgtccttctgatgactcactgtctcctgtcccctctcacccccagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcacacatctga

SEQ ID NO: 122 - DNA, 26869 bp, Homo sapiens
tcccggagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggtaggacgcgctcggcgccctgccgcagctgctcccgcggggacgggaggcactcggagtccgttgtatgtcgacttcccagggccgtaagcgaactttgttttttaaccaagaagtcagcctggtttgtctctactcgctgcttccccccacccctcgccccagctcctctgagcgaaagtcaacgttaaggggctcaggtgaaccatgatgatgaccttctgttgactttgaaatattggctcttgtgggtgacaaaagccagacaagctgtggctgtggtccgattttaagacgaggttctcaaagatccaaaggagggaaagggtattggaaacactgtgtatcatctgagacacacgtgtcctcatgatcttaaatgcctactttaaagccacctaatactgcccttcattgtggtcagaagagatttctacaaaagcactcagaattctggaggcagttgtgattttgccatgtggcagttggtttgtggagttgggcaggtgtgaaagggtaaaactccacttctgaatgctgcttctgccccctgggacccagcacattgttagaccatcttcttgactgaaaattctctcctgatgctgagccctgcaccaccaccttccttttcctaactatgaattgatggcaaagtccactcaaaacaaccagttaagtgctcacgagagagtagtcaagcacctccagaaagaaaccgggtttttgttcacatagcaggaagtgactccctgggtggtaatttatcttggaaacacaggtagattggcagaaaaacgggaacatgtaggtaccgcgatgttggtgcatgtccattactttgggataggctttctcagtctttcctcaaatgatagttgagccagttttccagtggcaattctgagtgacttgcgcttgtcttatggtgtggtcaagggacgttcagaactacggaaaacttttactgaaacagcgaagcagagtataccggcatgagagggaagatgaacactcacctatgtaccactctttgacaataaatatagtatttctcaaatcagtctcaagactgatcctgtctcagaacagaccattgttctctcatttctctaatacgctgagaggaacactctgaataaaggctaagtggtgaggattggaaacgtgtgggagtgaaggggtggaggtggatgagtgcagtggggagtcacagtttgccgtacaacttccaagccaagaggccatgaatagaatatctgaaagcatcgttattaatgcacccaagtaaagtaaatcttagaagatactgctttctaaattttactttggggaaaaaaattccgcgtgagctgaactctgtaggagattgatgctaaagtgtttctttattcttcttccatcatgttggtggtggattagtcactcgtctttgactagtttgatttttgcattaaatgaccttgctgtcttctgtggtggaggtgtgtcggggaggggaagggtcagcctcagtgttgctgagatgctggtagtttctacctggaagagcagacggcttcttattgggtttttaaatgtttcttgtaaatttaggtgttaggagtttttcttcatcattctaggagcagaatttgctctgagggaggtcaggattaattggtatggaaagaggccactaacattgaaagttaaatatttttatttagctttgacttaatggatagggatagggtttcagactagaatttaactcaaatggaaggaaaaacactgtgtaagttagggtaagggaaagaaagatcctgtagatatgattcatcaattttaggttatcttttgggtggaatgaaaaactttccaggtgaccctgtcagaaggtgatcgtgaattgaaaataaaatttatcctgtcccacccccagatttccaggtttactttggctggtttgtcacaaagctccctgccctttagataaatcacctttcgattggaatattccctggccaattagaaccaaatgcaaaccaggcttgagcaaacaactagtgtagttaaattttttttaagtgtgctttgcttgtatacagaagtctccttagtgatgtcttgtggtcttgggtttcttgtttgaagttcattattaaagtcatggtagaaacactttccatttctacatgatttttattggtttcacattaatttatccttctttttcttcactcactttttatccctcagctgagctcctcattttgtgctgctttccagagcagtgatagagacccagtttaccggttcatccttcacccgtgttttcaagaaaaactaaagttttaaatttatttattattattatttttttgagatggagtcttgctctgtcgccaggctgtagcggctcactgcaatctctgcctcctgggttcaagtgattctcctgcctcagcctgctgcatagctgggaccacaggcacgccaccctgcccagctaatttttgtatttttagtagagacggggtttcaccatgttggccgggctggtctcgatctcttgacctcatgatccacccgcctcggcctcccaaagttctgggattacaggcttgagccactgtgcccggcccttaaatttatttttaagttttaattaaggaaattttcaaacatacataaacataagaggctaatataatgagctcccatcacccaatttcaacaattgccaatatgtacatttgttttagaccaattttttttagctactttaaatttcttgaggttatgcttattcatgcacttacccaaatttcatttctttttttgttctttgctagacttggaaagatcattgaataatattgccctttatctcaatgaaacaatagcaaagatattgggagtaaaacagaaagatacactggacctaaaattgaaattgtggaagaatatagaaagaaatattagatggttctgcttcctgccaagaaagttgttaatggtcagaatttgtctacctcatctttgctggagaaaaatccaagggtgttgaagaccccttgggaagtggttcctgtaatgtacagctgtatggccccccctaacttcaagcatgatcattgctttcaggctagcaaaggatttatccgctcgctactcccttttggagattttagaccatatccaagataaatattggtcataatttgctcctttttctttggctgcctagatcttgaaaatggctgttttccagagaatgtataatttttagaaccaaaagtccctctgcttcaaacagctcactgtagactcactagttagtgactctaataagaagaactaccttttattgagcagtttgtattgtctggcactgtgctatgcactttacaaatactatcttgcttaatcttcagaaacacagtcttaaacatattgagtgattaaatactgtgcccaaagtttcaaagtcagtggtaagaaacagtttaaatgggggctgggagctcaggctcagtgttaactaacttcgtggctttaggcaagttgcttggtttacaccaggtgcaaaatgaaaggaaataatgccgtaaagctgttggaggaagaagcattaaataagatgatgtttatgaaatgtttagcagaattccgagccttcatcagtgttttaagtctccagaggggaaatttgggatcctaacctagatttgtgtaactccagagactgtgttatttccttttattctctcctacttccgacctttcatttattcagcaaatgttatggagtgttcagcctgtgtgggatgctgtgcaggggtggtggtgccatgatgaacgaatttatactttcgtatactttgaattgtaggatggtctcattcacacttgactaattcttaggcttaagaaaaccctcaaacattgaagtgggtcagttgagtacatttgaagaaaaaaatagagtactgtgctgatgttttcctactgttttatttatttatttatttattgagacagagttttgctcctgttgcgcaggttggagttcaatggcgcaatcttggcccaccacaacctccgcctcctgggttcaagcgattctcctgcctcagcctcctgagtagctgggattacaggcgtgcgccaccatgcccggctaattttgtatttttagtagagacggggtttctccttgttggtcaggctgatctctaactcccgacctcaggtgattcgcctgccttggtgcctcccaaagtgctgggattacaggtgtgagccaccgcgcccggcttctactgttatttttaggaaaacatttattgatagggtttgttcgtaggattcctgaccagactagctctggaaggtggcattgtgaggactgcattgtgaacagaccaattggtcctcccctggaaacaataaggaggaatgatgaaacagcaaaacatttatgaattaaagaagatgtgttgcaaggtggtgtgtttattccttgctgttgagcaataacagttttggcccacccttctcatgtgaggtcaggaatatacattatttaatggagcttatcatggttgcaaactactttaagggaaaaatgaagcaatgtactatgaagtgatctcgcaggatccaagtgcaagaaatgcagtcagggttctcagaagcttagaggtatgaactaggaagcagaaagtccttaacatccaggacagctggtgtgttcttttctcaggagcctcatgacctccatctttgcttccctgcttttgctcttcatttcttatcctcttttcaatccagcttttgctgccttcccatgcacatggctcaagatggctgccccacaatggccacctcagcctttagttgcagatgagcagagacttcagtaacattcctggatccctgttttcatcgcctgggagaaagtctgattgtctcaccttggctcaagggatctatcagccgtagtctggcacagtgggaggcatgtggaaaccatgcatcacaaatatggttgccagggcccatgagagttatagctcttagagcacagagtttgagagctggataccataaatggtatctctgcaattagaatcttagaaatctacctgtgaataaggtattttggggaggagtgctgctgagtttgaagctctggaacactgtgaataaggtattttggggagaaggagtgctgagtttgaagctctggatcatctttctgtaaggatgtaagggattcctataaaagcttttgtattaaaaataacttagctcctgtaggaaggaaattactccacagtaataatttacagaatacagtcccagtgacagtgaaacaagtctctccaatgggcaagttttcatggggttttttgtctattttgtgaatgacatttggaaacaaaaaaggcaggagggtgtgtgtgtttaatttgtaatttcttttgctcaattttgggccactggccacttcactataaccttatctgcttcagagaagtggataataaagggatatcgatttaattcattcacagatcactcagtgctgcacactgtgggagacctgtccgtggatggggaagggaagtgcccagtgattacaaaaccacctgaagaactaagctgagagttgagtgtagtgtgcagtggttgtcaccaattctttctctttttctggttaaaaagtgcacgtttacgctcattagtcattgtttctctttgggttttctccaatttctctgttaatttaaaatgaagcaaccagaacaagtgatcaaaactatacaggatgttaataatatgggtttttagggctagagagatattagaagtcacatctatccaatgtctcagtcattcagcagttgttttcatatttggagagatgatatcttgagcagatccttgggaagggatggataaaaggtactttaatagagaaagggtggctgggtgcagtggctcacacctgtaatcccagcactttgggaggccgaggcgggcagatcacaaggtcaggagtttgagaccagcctggccaacatggtgaaaccccatctctactaaaaatacaaagtctagccgggcatggtggtttgcgcctgtagtcccaggtactcaggaggctgaggcaggagaattgcttgaacctgggaggtggaggttgcagtgagccgagattgcaccattgcactccagcctgggcaacagaccaagactccatctcaagaaaaataataataataattaaaaagaaaatagagaaggggctacgctggctgggtcagacagactgggaccagggtcagtaggttaattcagtggcatcaccattttatttgggaattttaaatataattctgactgaaaattgataaacacccttaagtggagttatgcaagcctgtctctgcataaggttttggagtatcatgaatgatttccctttctaacctttctgcttcagctcaagcaaaattggtaaaatttttcctgattcctgaatctcctggaaaaacttgtaatttcataagtaacaaacagccctccattttatgaccctatcccaagaacacaccatgtatgaaagatttctctgaggaagcttaaaggtcagggtggcgttctacccaacctctaatgagcagagtttaagcactgccagcatcttgtgtacttccggataaagcttggaaggctgctcacctgtgggccatgtttggtttggcaaggcctctgcttttgacccaactttgcagccctaggtaaattaaattacattttgatctgtgcccactgaagaccaagaagtagcttgcaggttaacattatggagaaggttattaactttttgttaattattacggcaacagactccacaattccttggtagcagcactttgtagttgttaagtgatattgctctaagaaacgggtgtcgcttttctctagtgtttgtcaaatgcacatgttctgacagtaatgatagttcagatctattttgctgggcatctgccaggggtgcccagtgggtagctgaatccagaggcactggaattgtaaatacaacagacaaatcatttgatggtgccagactaaggagttcagctttggcagattgccaggagccgttgattgggctcagattcagtgctatgtgtctgtttgccaagcaagattagttgtcttggttaattatacatagaatttgtaccccctttctctcgattatttccatcttaaaccggtatgacatttactttaattttgcatcttgttttgatattgatttgtgggtgagtttctgtccctgtttttggtgagtctgtagtgactacgttttcctgccccggtcctaacacaatcccagccttacagaccctgggtttgctggtgtataatgcaggctttcacatcttgtattggattcatttggtaccttgttacttagtgttctccgtgttcagtacagtgtcaatacctccttattaaatcaagctaatttttgattctttagaaggtacaatgattctcaagttctggagtacatgtgcctatcttatattaaacattagtttttctttacaaaatgaggccaaaatacttattgttgccatacaaaaataattccagaatacaaagaatcaaataatatgatagtaacctcaattctttgtcagtgggaagaaaacaaaatgaaaaactcaattccaggtgtcaataacatctattttttattctaatgtgagaccctgaagttccatctttttgaagttgtcaggataatttcatttgagcattgcttggaagctgtaaggatatactgtttgggacccttttatttatttttatagagatggggttctgccatgttgcccaggcctcccaaagtactgaaactacaggtgtgagccaccaggccaggccaacaaaaccccttttaaacacaaaatattgaagattcaggcaagaacatgcagtattgctagagaagggcctattgtgctttctttgtttagttttactttttaggttcactatagaacctcaagttgtcttttttttttttttaactaaactttctttcctttcttagtagaaaaatccttgaggggccctttcttagtagaaaaatccttgaggggggaagttttttaaagtaacttactgtaaccataaatcacttgccgttggttcttgttcttcctgtaatccattttatgtacttttgctagagtgtagtagtcccaattccaattctaatcatgtagtctctgtgcttaaaacaaaataatccaaaaatccaaccatgctccttcttcattatctactatacaacactgtaaagactgtaaacttagccagctttgacagccctctacatctgaccacatctgacctttctacacttaatttcccaccactgccttcctttcctcccagtccctgaaatgctagaaactaatttgccaggcataatgagcttccccattgtcttccactcatcaaaaatccatctctaccgccttctagtgcctgttccctgaagtcttcccttctgctccccagaactctgtcgtggctcaatccaggctgcccagtacatggatttattgggctgtttatgctgtccaccgtgtgcttagaaattccttgaatgcagagactgttaagctttgtatatacttttagtgcctagaacagtcccttatacttcataggtgcttgttggcttaatttcatcttcaaaaggaactttgattttgatggatatttgaatgttaaaaaaaaagctagaattttttttgggggggatagaggggaatgacgggggaagatgggtggctgcagcttagtctctaattcgatgcctaagtatttaaatattttattagagtgacatgttatgtgagaccatctcaatggaggaccttagctttgtaagttttttttttttctcagtttcgaaatcctaggtttcaccctagaaatacccgagtcacacctggatcctggcagctcatacctacaggtctggctcagagacgccagggccacgaggcttagggccccaggttctggtcctagctcagcccctggcaagtttcatggtcctccatttccacttctttatggatgagttagatacttgttttcatttttgaacttaaatttggtcagcacctaccacttgacactaggatggacacttcagattttatttcatcttcctatgatcttgggcaagtcagttctctgagcccactttcatcatctataacataggcacaataatactgtatgtctacttctaggattataaggaattaacattgagatgacatttccatttgagaaggaaaatagttgctttcagtgccttttatttgattcctggagagagcagactcgcaccgacattcaaccccagcgctgatatgacagtaatcctcagaggcagagcccagcacaaaacagcaatgctagaaagttacaattggaaagtttcctgccagcttcgggaatgacactgcaaagctgatgccagaaactgccagagtaattctcctcattactgctctacccacccactttcagctccccaaattaactagtgcagttgactaattcctctttacctttatcatttagggtgaggcattgcacaaaaactctcgactttgccatataagggctgtggttctctgtggtccctggataagaggcatcaccattatctggaaacatgcagtaaatgcagattcttcatcttctccccagacctcctgagttagaaattcacaagttctccaggtgatctcatacatgctaaagtttgagaaccattgagtaaagttaatgcattaagaagagattagatagggatggtggcgtatcttcctacagtttccctgttaacaagaaagtcagaggtcagttgatcagacattagattatttattgctaaaactaaaaaaaaaaacaaaaaacgatttttagttcacatttatagcctattatttgtaccagcatatttaattttccagaactagaattgaagcaaattttggaaccagttccctcctgttatggtgaatggaggtgaatgtctggcctttggcaagacaactgcatttgaggcctatgtggaccctgcaggggctacagagattttatggtgggcttgaggttgacctgcactgggaataaccaaagcaaagacaagatgacttggacaagtagggtcaattttcttggcctcttgcctttgttaaaattccccctttggatctttgagtttacagactgaataccaagcacactcttttaaaaaaattcttgcaattgtttgtattttgtgatttttctatcactctggaagggtgataggcaaggatgaggtaggtggagtcaaatatttcaagtagaaccaaagatcttagttccctcaaaaatgaggtgggggtgaatttgctaatgtcagacattagataaactgagttggtaaagcacgtcttaagacctcacactcttcagccagaccaactgggttcaaaaaggcaagttacctaagctctctgtgcctccatttcctcatcggtaaaatggagataatgttcctacttcatgcggttgttagggagtgtgaaggaggtccgatttgtgaagcacacagaacagtgttgggcacatagtaaatgctttacaaatgtttgtttagtaaataaatatagccactgaatttcatgagttctaatctacgctaacttgctgtgtgtcatttctttcattcagcagatctgtttttccaagtgctgaaatgcatatgtaggtttctcctgttttaagattgtttcggccgggcgcggtggctcacgcctgcaatcccagcactttgggcggccgaggcgggtggatcacgaggtcaggagatagagaccatcctggctaacaaagtgaaacccagtctctactaaaaacacaaaaaattagccgggcgtggtggcgggcgcctgtagtcccagctactcgggaggctgaggcaggagaatggcctgaacccgggaggcagagcttgcagtgagccgagatcgcgccagtgcactccagcctgggtgacagagcgagactccgtctcaaaaaagaaaaaaaaaaaaagatgattgtttcaaggcatttttcatgacattttgattggtaacttcgttttttcatatattatccattattaaagtcttgtcttaccaattattttgagttatggattctttaagtactttaggattaagttcagatgaaaatttcaaatattccattctctgatgagcctgcagtcacaagtattccttgtctctgttatgctcaaagcctttagagagccataggtgatgttttattattctgataaggctgttttctcatatcaaaggaagtcgaatattatgtttctctatagaaatacctgtgataacttctaggtccatagggtaacttctagggttaatgacttctaccaaggacttggagcggtgtgactcagggcacacactgctgctcaccttcccagtaaccaggaaattaaacaagatatgtgcaaaatgccaccgggctacatgaattctcaggaaacagcagctgttaatatttggggaaaggcatcagaaaggaaatggttaaatgcgtcttgatgtccttatccctgggctggactgacctttgctgattttataattgtgaggaagcccggttgaaaacatttctctggtgactggggtagagatgggggagggggatggttcccagtgtccgttcccagctcaggctgcctggcggtgtgctcgggtgtgggctggctgccaccctcacgcagcgcacgtagccctgtcactcagccatcaccctgctggcttagagccagtcctccacgggaagggcggcctgcccaaacccaaacaccctgtattaatatggcgatgttgccgggcctgtttactgtgcctaattgcatgggctctggctgaatcccctccaaggagaagaattaaccacaatgcagaaaggaatgacaatagtctcttaaattcctggcctctgagcctttcagtggcttcttgggggagggcgattcactcagaaggtcgtgcatgaaatgcgggatctcctggaatagaatcttgatcccgcacagttcaactttagaggcctttgaaccccctagaatttcgtgcagacttctgtgtgtgcgtgcatatttcttacatccttttaatgtaagaatctcaaagggctattgtgcctggtagaactatcatcactgacccaggagaactagatggatgcttccacgctctgggtagttaatgatcctgaagctaggaccaagttcatctgaggacaggttttaaagtgagaatggtaaattctctgctattcaggcacggtgctctcacctggccaggagggtgtgggcagacccacttcactagagcaaccgagagtcggttattacttcttattttttattttcagaagttctgaagtttctacaatattagaaaattcaggtgtaggtatgtgatgaccgttgttctaccttgggagagaggtcatgtgtagcagtgttctgggtaagtaggttctgcgagaggaattatttttagtgtggatttaggacaaatgaggagggcagaagtagtctgcattgtggaagtagagtagtaaaaaacattttcatgaataatttggggtttattgaaaggattacctacctgacaggtatttgtctggtattctgaatcttccaaatggtctggtgagatgctgaagctttggaaaggtgaacacggtggctggacacagcttgtgttatggcccaccaaaagtgtattttctctttccccctcattttattacatcagtctgtaactagaggcactagaagtcaggaaatagaatagctaggcttgctcttaaccaacaacaaagatgaccagcaagatgccaaggtaactgatgacagtttacacaaaatttcttacttttctaagagctcacgtttgcttacaactattttcttcatgcccgtctaggtgaagtttgaatgtctaaaaattctaaagcacttttaatacttacaagttagcactgcttcatcatcacattgagaccttttttgttcaattctgtataaaggataagaccagctggcagcaaatgtgaacttttgcagtgacattttcttaaaacttggagaaagctttgcatagttgccatcgtcttgtaaagaggccctgtgaacattgttctgtaggaatttaatttacttgacaacagtagatcccacaaaatgtccttgaagatcacatatccctgaacaagggagatgatagaaggttgaagtagtaattccagtttgcttttcatgtcctccggatttaagttgcaaatgattttttgagttcttttctctcactccttgtcagagccaagtggaaaataatggaattggacattttggcttaatttgtctttagatttttttttttttaaataaaacttgtaaagggcatgtctctttcaggttttgtttttttttttctccagcctttcctccagtatgcctgcatatagcagtttgaatacctaaacgtttttttggtttttctttctttttaaataggagaatttcagatctagagctgctgctagcacatatagtgcctttgttccagctactaatcccctttcccctccctcagatgaattaccaaatggggcccctacatcagcagggtgccttgatgaaggcaggacctaaagtatgtgatcatggggatgccctgctcactggccacagtcaaggcgtgtgttaaaatatgtgctgaacataaaccacctagaaaaatagccctggaagtgtagccttcagctcctctacccacagctgactaaaaacattggcaagtttgtcacctaggctgttgtcacccgaatataaatgagacccatttctggccagaaaacttcagctatcacagtctacattgtgatgagttgcttggctgtttttccaagcaaaagaaggtgcatggtctcatgtatttcctcccaactcttatttatttatttatattttttgagacagcatctcgctctgtcgcccaggctggagtgcagtggtgcgatctcggctcactgcaacctccacttcccaggttcaagcaattctcctcctcagcctcctgagtagctgggattacaggcgtgcgccaccatgcccaactaatttttgtatttttagtagagacagggtttcaccatgttggttaggctggtcttgaactcctgacattgtgatccacccacctcggcctcccaaagtgctgggattacaggcgtgagccaccgcgcccagcccccaactctttacacatctagttgtctgtgttgttgtgcctgtgtcgttgtgccttatggtggagaagggaaggatcctgggcctctgttgctctgtactgggtggacatgggggaaggacttgatggagcgaggtgtcaggatgcaattggaatgtggatggcattcaggatgaggcattgtctttggataggatgtgtttgagtctggtggagagagatggggaaggtgcccactcagcagctgtctcaaagtagctttacttcttggaagtcctcacacagtgatctcaaaatatagcctgatatatgtgtgtgtatatatatatatgtgtgtgtgtgtgtgtgtgtgtgtgtgtgtgtgtatttatttatagccctgattaaaaaattgggatcaacaatattcaggagagtttacataaagatctgattgcctgctactctcataaaatctgaagatttgctctcattgaaaataacagcaagtcccctcagtgtaggtggcataacacacaccagagttctgactcatgtataccggattggcttcaatcatttgttactcgcaaacatcgaaagctattttagtttgccagtcctgggttcaaaactacaaaacacttaagtagaattgggtctctgaagaagagacgttctacagcttcagttgaggggaagacaaacataacacatcatctttaaaaatagctaacatttattaagcacttagtgtgtgccaggccgtgcattaagcattttacatggattatctccctgagtctgcataaacccattttacagatgaagaaaccaaggtgtaaatgagctaaatgcagattatcccgtacttaggttgcattttattcaaagtacgctttgctcaagaccatgcttaattcaaaatgaatccttacaaaggttggctggtatttctacttagcagctggaggggatctagcatttgtcggtagatcagaatactagtttaaagctccttcaaccagatagttttgaaatcacgcttttctcaacaaatcttaaacaatggattttcatttattggaaattttgcaaataaaatgagatctaattagtactttaatttggtgagttaaattttgtataaaatgccactttattataacttgttcaagatcgagtcatactagtgaatctgtctcaaatcatgagcaatgtaaaatacatttctatgaaaatacatgttgcaactgttagcagagaagtggtaacggcagggtgggtgtatccccttctcacctgtgggtctgaaaaatgatcatcattgcctagtggatggtggaggtcactgatgccaagtttttgaaatggtttttacatgcagtcaagctgcggttgatggcattcaagagcattctgtttaggcattggaatggaaatcctggacttttatttttcaactttacctttggacttgatgagataggttttttttttttttttatgaagtcagctcactggtaactcttaacagaaccactgtttccttttccacctgtggcatttggggaccacttttttatactgggttttgactgttacggttctatatatctgtgtatatcttcaaaggatacatatacgtttgttgtctggacatggctgcatacgtgtctagagcacatattctggtctagagccagcctgggccggcctgattcacctctccactcatttcctattgctacagagctaaggagaggcctctgggaatggggatggtgggaggtggggtgggtacactatataatgtcagtggacagagcggtaaatgtgtaaggggacatgtggatttatcagtatatccaagaatagaactataggactatactgtatgtgctgctgtagatgacactactgtgttaaacttgcgtaaacttcaaatattaatctagtcaggaagttttagaaaataaaaagcctgtactaaagtaggcatcctcttgatatgtgtcagtttattgcttggcatgtttgttatatgatcattaaattactctggcccgttcttttaacaataaagcattgaagacttctcttctgttaaacactaaatcccttccccggcttgatgaggtttagatagcaactcagttggactgatctgtttccggagtttgttactgccccgtgcacaaattggcacagaagtgaatggctagttattgaagtcaggcttgcttctcggtgcatccttagcctcatggttttagaccctgtcaaagacgagcaaatagttgggaatgtgcccaagcaaagacccatctcctatggcactcatccagaaaacacactgataaaattggccaaatgtagcctcaactggcccactgatgctcgaaatgatttccttccattgtttccaacttgatgcatgtggtttctggaaccaggagagagggtgaatgttcactctggccagaaaaattatctctttgcctccctcttaagcagtcggatactttgctgacatgtaggggttttgtcctaatagtaagtcctctggaattggctttgtctctgtgtgttttatagatgcggcatttggtagaggatttacttttgtgagtttgtatccatcttttttttttttttcaatattttaatctgagctgagttctgaggcagagaaacactccttaatgacctgaagaactatgttgctttttcaagggttgatgcttagatcaagtcttagatcttcttgggcctttgacagctgcgtaacccaatcccctctttataggaaagagacagcctgggatcacagttagttgcagagtgaactatggcaggcatccagaccactgaccttttccttagagaagagctgtttaagcatataagattatagcattgatgtcatactttttcttttcagacacactcagtggggggagcctgagataatagggaatccagcctgtaattgtttgtggcttaagcgactttcattattggctctgtggtggctcttataatcctaatagctgcttccaggggtgggtaattctttagtcattataggtgactttatttgtctcttcttctcttgctaggcccatcaattctgtttgctaccaatcacccttcctcaagccatgctttgcttagtggtaccatcatttgttaaatcttcattgctgacgtcgcctcacagtttcaccttctgaaagatgttcaagctaacagcctaacttgagctctaaggatgacatcacattgacattttgatgttcaaaggcaggatatggggattgtttgctgcatgaggatatgaagtttgagagagatggtgatttaagctttaaaattgttgtaaagtccagttactattcagccttattattgatctggcatgcaaggtgtgttttgcctagttccgtgttttcatgctactattgagagtgactcggcagccacgttgaagctgattcattgaaccactagcccattagcttggggctctactcaaacggtcattttaccaatgaagcaacgctgccatttatcaggaaatatatggcctggatctttacatgtatgtttgaagataggtcttttaaaatgacagaaatagctattgatctaggtaaaatgtgaacttactctttagagaaagagccattcgctagttcattgatttatttatcacattttagatggacaccttctgtatgtcaggcactgtcctaggtgctaagaatacatcagtgagtagaacaggaaaaaaaatccctgtcctcatcttgtgttgctggttctaatattttccttgcacctactgcatccctataaaaaatatttttcaaacatggcggtatcctgtgaagaaaagaactggctttctatactttgctttcttccccctccccactctgtgttataatttttcccttggaacaattagaggtctgtttactctaatggtaattttcagtaggatttttggtacggttttctactttattcttccacctggttgatacaggtagcacttagacaaagagaacttcagattatcacctgattacataattatcaggaagaagacacatattaagatacatgcatggcttttttcctgaaaggaatctccctgtgttgtctgtgttaacaagttagggtgcggcttcctattgatcttcctctattctttctatcctgagcattttattgagtaagcctgaccttttcctcctttggtgattagttctgtcactttgtgtatgcaaatacctttagccattgttctgaaacagtgtgagtgattcagcagcacttgctaaacagtcataatccctaaactccacacctagtgactctgattttgtagcatgggaaactagaaactgcttttccaaaaaggagtattgaagaaaggcagggcatacaaacaggttatgcaaacagggcatgcagataggttactttaagaaagactgtgtaaaatgttctagaactgtgggaatattgttgaactactttccactgggcagagccatagtatgacctggccattgtgcacagaagagtccaaatttatgtaccatacatgaaattaagaagccagcaactacctgtaaatgtcacgtaacacccaaggagactgtgttacttatctgctcaccagtgggaggagaagattgtctgtctcagctttgttaaccagctttcttgggatttctccataggcaatggtggcttgctatccgggaaatggaacaggttatgttcgccacgtggacaaccccaacggtgatggtcgctgcatcacctgcatctactatctgaacaagaattgggatgccaaggtacttttgaataatgggagtagagtgtggggttagaaactacaggaaaatgattcagataacttagaggagagtttatattgagttcatagttgccgtatctcccactgatgaaacatttctatttccatttcataacctcctgcgacaatggaattagtcctaaagttgttaagaagaaaacaatgaagttaatttggagtggggtaggtagggtgattattaaccctacctctgggaagggtggttgatgaagggaaggtaatttgatattaggattaaggattaatttttttcagtttaattcagagttgttctgactcaatgcagaataggatatacacttttccctcccagcagcagcattgagaaagttccacaaaaatagaactgtaggctataaaaccatccccaagagagatttcccacacagtcctctccctcggggtggtatgtctcattgatggctgcttgccatggcttactatggtttgtgaatgccaaaggctttgtggcttatttttgtattatagaacttatagatagatggagatatgaagcctggttccatgcttacagacattcatctggactctgtatgctttccgaaagttaagaatgatttaggagtctgggaagtcagataacttttcaagcttatttggcttttgaaccttctgcatctcaatttcctgttcattaggcaaatactggctgtcataaagcaataatatttatccagagtcagaaaaacgaaacttgggaaaccattgaatcagtgaaaaggcctatctcttctccctgtttggtaacatgactggaatacatccattaagtctcctttaaaatcttgagaggtgctgatagagacaagagaataaagttatcagactggtaataataaattgcaaggtctggaatcatttaacaaatatttgagttcctgctagtgtcaggcgttgtattatgaagaaacattgatgtgtgaggcctgaactttactctgaatatggttattctagtaggatgaaataggttgacatgtaaaaaaaataattcaaggaagagagtggtgtatgtcataaaaggtgcagattaggtggtctgagagttcagtaaaaagagcatgtaacttccaactaatgaggtcagataggagctaagggagttcagaagagctgtaaattctaattgaaggggaagttacatgtgatgattttcttagaaagttgttaatggttagatggaaccatgtgagatcactgggcatttttttttaagtcaaaaacactcaaatattggcaaatcggtatgattcaatctaatagtactctattttacgtccatgggctttatgactgtggggggtgggagtgctttttttggtttaaggtgaataaggagatatctctagctaagtttgatataaaatttggtacgaagtggctgggcgtggtggctcatgcctataatcccagcacttcaggaggccctagtgggcggatcacctgaggtcgggagttcgagaccagcctgaccaacatggggaaaccccgtctctactaaaaatacaaaattaactgggcatggtggtgcatgcctctaatcccagctactcgggaggctgaggcaagagaatcacttgaaccagggaggtggaagtggcagtgaaacgagatcgtgccattgcactccagcctgggcaacaagagtgaaactccatctcaaattggtacaaactatgaggttgaagtaaaaatctggggtaccatgcatttggagtggtggttagcagatggcatgtttctaaatggagctgaaatatggttgttgataaactacatgagaggtaagaaataatcccccttctttgtgtctttcagctacatggtgggatcctgcggatatttccagaggggaaatcattcatagcagatgtggagcccatttttgacagactcctgttcttctggtcagatcgtaggaacccacacgaagtgcagccctcttacgcaaccaggtaatagccggagccatgattcctcttccggagcttggtgtacaaaccctagttccagagaactctttaaacgtgtgtcctgtgcatgtgggggattgaccacaccccatagctgatagcaaacttgtttggagtctacaaaaattaaaggggaaactttgcgttctttagcatatcaaacctaacctcagtttgaaagtactattaacaagttgttttctattagatgagcatattggattccaatttctcaaaagtatttttctcttctctcctttcctcccttctcttatctctctttccctttttttaaaaaacctaatgttgaactatgcctagagaatgttggctgtcacatatcaggaattctgtctggttactttggatgagtttacaagctgctaattgcaagcagagaaagagccttgagaagagaaagagtaatttgttttgactttctctttttgtcttttccttggtttgaaattggcttgggcttgctgtatccatggtccaacagttggatgttttattaatcttttctttatcatgtgcacatgaagattctcagagtaactgaacaccttagtattgtttaggaccaatctagacaatcttgacaaaaaatcttcattctcaattctgcctctcatttacctttgtctgtgtctaaagcaataagccgggcagcattggagggctatggagtgcagcttatactgagactagcattcaggggcaggaggagagaattttggtaggatgatgattaaaccctaacaagcctaattaaattaagatcacatgtgccctcctccggaagtcacacagcttagccccaaacccagttatatattaactgccaaatcggaatgtcttctagatgagcagggaacgaattctaccactgaagtcagcttttgtgttttatggggtatgtaactaaaccctgttgtttgtggcagaagtctttggttattccccaatctcatgatgactggccttacagggaaaacattagcaaatgttgatgagaagtcccttgaaaaaaactcaagtgctatagaaattgttagctacggaagtagctaacaatcattacaaaatgaaactttaaaaaaaaaccaagcatgaaatggctcccattacagtctatccaatgaatgggataaagcaaattagtggggatgcagtagaaagctctggggcattattattattcaattgcaattttgcctcaatgtccaaaactaaagaaagcaagccaagagttttaaacatactgtgatttacataagtcgtttttcaaagcttcactcaaatgtcatctcttctctatgttctcgccaccaacttgggtctcccagtctttagcagaatgactcccttctagtcctttctgtagaggctatgtttacctgttgcattattgcaaaatcacctgtctcccctacttggagcctgagatcgcagaggaagatctgatcacagggtcatttgaattcctaatgcccaagataatttctggcacatacctggaattccttatgcattttattacattgaaatagaattaaaaccagagaagttaattttaaattaaaatcagcgtagacaggccgggcatggtggctcacacctgcaatcccagcactttgggaggccgaggtgggcaggtcaagagatcgagaccatcctggccaacatggtgaaaccccatctctactaaaaatttaaaaattagctgggtgtggtagcgtgcacctgtagtcccagctacttgggaagctgaggcaggagaatcgcttgaacctgggaagtggaggttgcagtgagccgagatcacgcctctgcctggcaacagagcaagactccatctcaaaaaataaataaataaataaataaataaataaataaataaatcagggtagacttctaataatagagaaaactttaaaacttttaatgtgagatttataggacatttgtgtttctagtagtaccattaaatctctttccttatatctgcttatctttcacagatatgctatgactgtctggtactttgatgctgaagaaagggcagaagccaaaaagaaattcaggaatttaactagtatgtgtttgataattttctgtgacttttgatcaagttaatccttgacttttattcaattttatgtagttttaaacatgttctgttcaatctgttacggcttagctttatatataatgacatcttgatgggttttatcctgaaaccttggccttagggctcttagaaaaatcagaaacaatgcaaggggcttcccctgagaatgcccactgaatgtatgatggtttatgatagatgggaaatagttaactttttcctattaatgttaaccagtcaaatgtaacattaaattttgcccatgatttttggcatattgcaaaggaaatataatggaacccagttatgatggcaaaatttattatattgggtgagactgtgactctcagtataacagcagggctcatgtaatataaactgaatataacagcactactcctatcccttccaaccagtattagaaggcagcatttcccaaaatacgttgcattaaaacacaaatcctgccaatttggtaaattcctggtcccaaaaatgtgggaaatgttgcatgctgtatgcctgtcttaaaaagagtcacattgctcactagcatattaaattaaggcgctaagagatcctgcagtaaggaaacatatataatattgcctagcccataacccatttggactgtatacctctcaaataccaaagtggtctccaaattgcacccaggaaatctcagtttgttttctcttccagatggcctacactgcttaactctgatatgtgagtgaggctacacttcatacaacttatgctcagcattagcccaagaggtgccaatgctggatgtaaacccaaagttcctccacagtctgtgaggcatatgggaaagatcccattgcaaagtcaagagagaatcctttggcagagctctattaggaggcttatataagatgggaagtgtttactggaggctttttggtgacatttgtgacataaaactcatcagagctgactccataccctctttattctcctttctgtccccaacccagggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagccccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgttttttttttttttttttttttagttttcctttttaatgagctcaccctttaacacaaaaaaagcaaggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttattcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcctacattagcattctaa

SEQ ID NO: 123 - DNA, 26688 bp, Homo sapiens
tggtggcggcggttggggctcggcgctcgctcgctcgctgggcgggcgggcggtgcgatgtccggagaggatggcccggcggctggcccgggggcggcggcggcggctgcccgggagcggcgacgggagcagctgcggcagtggggggcgcgggcgggcgccgagcctggccccggagagcgccgcgcccgcaccgtccgcttcgagcgcgccgccgagttcctggcggcctgtgcgggcggcgacctggacgaggcgcgtctgatgctgcgcgccgccgaccctggccccggcgccgagctcgaccccgccgcgccgccgcccgcccgcgccgtgctggactccaccaacgccgacggtatcagcgccctgcaccaggtcagcgccccccgcccggcgtctcccggggccaggtccaccctctgctgcgccacctggggcatcctccttccccgttgccagtctcgatccgccccgtcgttcctggccctgggctttgccaccctatgctgacaccccgtcccagtcccccttaccattccccttcgaccaccccacttccgaattggagccgcttcaactggccctgggcttagccactctgtgctgaccactctgccccaggcctccttaccattccccttcgacctactctcttccgcattggagtcgctttaactggccctggctttggcagcctgtgctgacccatgcagtcctccttaccatccctccctcgacttcccctcttccgatgttgagcccctccagccggtcctggactttgtctccttccctgccctgccctctcctgaacctgagccagctcccatagctcagtctggtctatctgcctggccctggccattgtcactttgcgctgccctcctctcgcccccgagtgcccttgctgtgccgccggaactctgccctctaacgctgccgtctctctcctgagtccggaccactttgagctctactggcttctgcgccgcctctggcccactgtttccccttcccaggcaggtcctgctttctctgacctgcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggccactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggccgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctcttcagactgagccccgttcccctgcatccccgttcccctgcatcccccttcccctgcatcccccagaggccccaggccacctacttggcctggaccccacgagaggccaccccagccctgtctaccaggctgccttttgggtggattctcctccaactgtggggtgactgcttggcaaactcactcttcggggtatcccaggaggcctggagcattggggtgggctggggttcagagaggagggattcccttctcaggttacgtggccaagaagcaggggagctgggtttgggtcaggtctgggtgtggggtgaccagcttatgctgtttgcccaggacagcctagttttagcactgaaaccctcagtcctaggaaaacagggatggttggtcactgtctctgggtgactcttgattcccggccagtttctccacctggggctgtgtttctcgtcctgcatccttctccaggcaggtccccaagcatcgcccccctgctgtggctgttcccaagttcttagggtaccccacgtgggtttatcaaccacttggtgaggctggtaccctgcccccattcctgcaccccaattgccttagtggctagggggttgggggctagagtaggaggggctggagccaggattcttagggctgaacagagaagagctgggggcctgggctcctgggtttgagagaggaggggctggggcctggactcctgggtccgagggaggaggggctggggcctggactcctgggtctgagggtggagggactgggggcctggactcctgggtccgagggaggaggggctggggcctggactcgtgggtctgagggaggaggggctgggggcctggacttctgggtcttagggaggcggggctgggcctggacccctgggtctgaatggggagaggctgggggcctggactccttcatctgagggcggaagggctggggcctggcctcctgggttgaatggggaggggttgggcctggactctggagtccctggtgcccaggcctcaggcatctttcacagggatgcctgtactgggcaggtccttgaaagggaaaggcccattgctctccttgcccccctcccctatcgccatgacaactgggtggaaataaacgagccgagttcatcccgttcccagggcacgtgcggccccttcacagcccgagtttccatgacctcatgctcttggccctcgtagctccctcccgcctcctccagatgggcagctttggagaggtgagggacttggggggtaatttatcccgtggatctaggagtttagcttcactccttcctcagctccagttcaggtcccggagcccacccagtgtccacaaggcctggggcaagtccctcctccgaccccctggacttcggcttttgtccccccaagttttggacccctaagggaagaatgagaaacggtggcccgtgtcagcccctggctgcagggccccgtgcagagggggcctcagtgaactggagtgtgacagcctggggcccaggcacacaggtgtgcagctgtctcacccctctgggagtcccgcccaggcccctgagtctgtcccagcacagggtggccttcctccaccctgcatagccctgggcccacggcttcgttcctgcagagtatctgctggggtggtttccgagcttgacccttggaaggacctggctgggtttaaggcaggaggggctgggggccaggactcctggctctgaaggaggaggggctggaacctcttccctagtctgagcactggaagcgccacctgtgggtggtgacgggggttttgccgtgtctaacaggtaccatgtggggttcccgcacccagatgagaagccccctcccttccccgttcacttcctgtttgcagatagccaggagtcctttcgtggtttccactgagcactgaaggcctggccggcctgaccactgggcaaccaggcgtatcttaaacagccagtggccagaggctgttgggtcattttccccactgtcctagcaccgtgtccctggatctgttttcgtggctccctctggagtcccgacttgctgggacaccgtggctggggtaggtgcggctgacggctgtttcccacccccaggcctgcattgatgagaacctggaggtggtgcgcttcttggtggagcagggcgccactgtgaaccaggcagacaacgagggctggacgccactgcacgtggccgcctcctgtggctacctagatatcgccaggtgaggcaagggagggccgggcaggacctggtcggggtgggggcctggaccctcagccctgaccagcccccacccccaggtacctcctgagccacggggccaacatcgccgccgtcaacagtgacggggacctgcccctggacctggccgagtcggacgccatggaggggctgctgaaggcggagatcgcccgccgaggtgggctctggtgtgctgtgtgtggggtgggggacacctcctcacccgtggtctccaggctgagagctttagaggcggcctgggcaccgaggctgaccctgcttcctaggattgtctttctttgtgcctcagtttcctcacctgtgaaatgggggtgtaggggcctgcctccaggattgcttggagcccagcacacgcacaggatgagaactcaaacccctaccaactgggactgtcaatccccctgagtaactgaggggattggaatgccggggcggggtgggtgggtggagggactcacccaggagtgcgttaggtaggattgctggaaccctgccgcaggtctttctgggaggggatgcgtttacttgggggggagtaggggcatgcaggggttgccagggactggtctccctgtcctctgagactcatcgtaccccaggagccttcatatggggtccaggagcccctgaaactgtgtctggccaggttcatttttctagggaaggggtgttgcttctagcaggtgtgtgatggccacacaggatccctgggtccccagcatgtcttctaaagtcctgggcttgcctcccagctctgcctgtgactggtgactccaggcacgtccctgaagcttgcttccctgatttcctaaaacaggaccactggtgccgcttcatggggtggttgtcagggtctggctgggttggagtggaagggtgtgagcatggttcccggcagactccaggggaccgtgtggaaggaaagggagactgacgaggaaatgagataccggcagcctccgagacttctgacgcggctgtcctgacggggccgctggccaggctgaaaggataggattccgcgtgggttcaggggtccacgagagccatgcgggaggactagctagtgggacacgtgacggcggagatctgaggttcgggagcccctctttggttgaaatggggagtgggtcaaatcagccctggacctggattctgtctccttcctcctccaactttttattttgggaaagcttcagatttacagaaaagttgaagcaatagcatgtgactacccatatgactttcactaagattcgccagtgctttttcttttttgtttttgttttttagacagctttttgagatgtaattcacctaccctacaattcacccaaagtgcacacttcagtgctttttagtctattcacggggtcgggcatttatgaccacattggttgtagaacattttcatcatcccccaacgaaaccctgcaaccgcttagccatcacccccaaccatgcacccccccctcccccccaccccacgaagccctctctgccttctgtctgtggatttgctgttttgtacacttcacataaagggaatcatacagtatagaatcatcagcttttaactttttgatagatttgtgttccttctctctgtccctcccttgcgatctcttcccaggtatagacataaacacattttttcctatcctttctcctcctgtttttttccctccatctctcccttcctttcttaccaccccacccctgcctttccattcctgagccttttttttttttttgaaacagagtttcactttttgcccaggctggagtgcaatggcatgatttcggctcactgcaacctccacctcctgggttcaagcgattctcctgcctcagcttctgggtagctgagattacaggcgtgagccagcatgcccagctaattttgcatttttaatagagatggggtttcaccatgttgaccaggctggtctccaactcctgacctcaggcgatctgctggcctcggcctcgcaaagtgttgggattacaggcgtgagcccggccattctgagactgtgttgcaggcattgtacatcttcgcctgatgcacagcaggtatctcctgccacaaggaaaacctcctgcagaaccacagtagggatgcaacacgctaccccctgtgttgaccttgatgctacactctcacccaccgcaccaaccttgatgctacactctcacccaccgcaccaaccttgatgctacactctcacccaccgcaccaaccttgatgctacactctcacccaccgcaccaaccttgatgctacactctcacccaccgcaccaaccttgatgctacactctcacccactgcaccaaccttgatgctacactgttgcctgcgtttctccttgacattctttgtagcctctcccgctctggttcagggcccagctagggatccagatctgggtgatttaggctccctctgtctggatcagtcctccttttcccttggaccccagggaggccgggaatggcctccagggggtctgtgaactttctgacgttgtattttcctgcagaaattgctcataacttgcatcagcttctcagagggggccatgcttcttccctcccgtggggtgaggagaaggctgggagggatacattggtgggggatattggcttgtaggatcagccaggaacgaagaccactggggccactggaaagaccctcagccgtgctgctcggggtgggactctgcggccccaaatcacaaggcgactgcctgtgacaccctgtgacacccggctccacacaggagcctcagaggggctgcagtgcgcaggacctggatcacaggctgcaccccagctctaaggagggcgggtcttttgcaccccctgcaggacacgcccacatgatgcagaattccccgaggtgctggcatccagactggctctggccatagtgtggccctggcagccactcacaggcagggctgggagagaagacagaccggcctcaggcacgaccatccccttcgctttccctggcttacttgctgttttcctctctctgggtctggggttcagtgagagcacgtgatctgctcagccagtcacctcgtggcctggagccaccgctccctccaacaccgcaaagtcctctggcccagtcgactcaggggctgaatcgggcatgactctttgcaagaaccaaaacccgttcctcctggctcaggccggaaaaggccatttgaggcctggcacagtggctcagacctgtaagcccagcactttgggaggccaagatgggaggatctcttgagcccaggagtttgagaccagcctgggaaacctagtgagaacccatctctataaaacaaaacacattagccaggcgtgggaatgcacgtacgctcccagctactcagtaggctgaggtgagaagattgcttgagcctgggaggtggaagatgcagtgaaccacggtcactccagcctgggggcaagaccctgtctcaaccaaataaaccaaaacaaaaaaggcaatttatatacccgtgttcatagcatcgttcacaatagcccagaggtaggagcaacctagtgcccatcatcgaatgaatggaaaatcaacatgtggcccatccatgcggtgggacatgattcagtcttcatcccagcacttagggaggccgaggcgggcggatcacctgaggtcgggagtttgaggccaacctgaccaacatggagaaactctgtctctactaaaaatacaaaattagccaggggtggtggcacatccctgtaacctcagctgctcaggaggctgaggcgggagaatcactcgaacctgggaggtggaggttgtggtgagccaagatcgtgccactgcactctagcctgagcaacaagaggaaactgtgtctcaaaacaaaaaacaaaacaagacaaaacaaaaaacacacaatgtagatgtatcttgaggacattatgctaagtgaaaagtgaaaataagccagtcacagaaggacaattactgtctgattccacgtctgtgaggtacccagaatagtcaaaataatggagacagacagtagaatggctgtagtcagggactgggaggagtggggagaataggaagtagtttagtgggtacacattttttaaaatgatttttatattttttgtggagacggggtttcaccacgttgcccaagctagtctggaactcttgagctcaagtgatccacccaccttggcctcctaaagtgctgggattgcaggtgtgagccattgtccctgacctagggtacacgattttaattttgcaagatgaaaaaattctggagattggttgcacaacaaccaattgtgactacttaatgccactgaattggggttaaaatggtaaattttaggctgggcgcggtggctcaggcctgtaatccagcactttgggaggccgaggtgggcagatcacctgaggtcaggagtttgagaccagcctggccaacatggtgaaaccccgtctctgctgaaaatataaaagttagccgggcatagcgatgtacacctatagtcccagctactcgggaggctgaggcaggagaattgcttgaacccaggagatggaggttgcagtgagccgagatctcaccactgcactccagcctgggcaacagagcaagactcagcatctcaaaaaaaaaaaaaaaagatggtaaattttatactgtgtgtattttaccacatttttttcactctgagatggagtttctttatttttatttttattttttatttttttaatttatactttaagttctatggtacatgtgtacaacatgcaggtttgttacatatgtatacatgtgccatgttggtgtgctgcacccattaactcgtcatttacattaggtatatctcctaatgctgtccctccccccaccccacgacaggccccagtgtgtgatgttccccttcctgtgtccaagtgttctcattgttcatttcccacctatgagtgacaacatgcagtgtttggttttctgtccttgcgatagtttgctgagtgatggtttccagcttcatccatgtccctacaaaggacatgaattcatccttttttatggctgcatagtattccatggtgtatatgtgccacactttcttaatccagtctatcattgatggacatttgggttggttccaagtctttgctattgtgaaaaacagcagcaatggagtttcactcttgttgcccaggctggagtgcagtggcatggtcttgactcactgcaacctctgcctcccgggttcaagcaagtctcctgcctcagccttccaagtaagtgggattacaagcacccgccaccatgcccagctaatttttgtatttttagtagagatggggtttcaccatgttggccaggttggttttgaactcctgacctcagctgatccacccgtctcggccccccaaagtgctgggattacaggcgtgagtcaccgtgcctggtcacattttttttttttaaaggcagtctatggccttatgtagctgaagtccatatgggctctaggcatagcttgatccaggggcacaagtgaagtccagagcatctctctatcactctgctgaactctgttggcttcactcttagacaggttctctccgtgaggcactcagcatgggtcctactgcaggcccatatcacagccaaaacacagcacctcttgccctgtgcgtgatgctcactgggccaccttggtcagatggcagctcctgagcccatcactgttgcaaaggtgacaggaaggcctggtgatgtgcgcaccctggagccaggctatgggcccggtcacattgaaaccatatggggcaaagtgtgggtgaggaaagtcaagatgaggtcacaggggaagggagaatggattttcgtaggcccaagcagcagctgtgctgcagggacacgcagcagcaccatgtcctgtgcagaagggaccctccctggccactttgcacaggggcatggaactggcaggaagaagacatgatgtgtttttgaaacatttgaagccagctcacttggaattccagcatccaagtcagctggaagagggggagttacccttggaggcaggcggaatcgaccattggatagctccaagtgctgacaagggcggacacgggagctgatttctgcctggtgggaaaggtgatgattccagctactttgggaagtggttggtcagcatggattatagccgaaggccccagctttgccttgttctagcagttccactcctgggcagcccgagagaggccttcccaaccatgggcagatgttcatcatagtattgtttgcagtagtaagaggtcggagcccacaccaaagaggatggatcaatcactaaactctaaatgagtgatctaagcaggggtcagcaaactttctctgtaaagggctagacaatgaatgtttcaggtgttgcgggacacaccatgcctggcaccactattccactagtgctgtggagcgggagactgctagggatggtgtgtgaatgaatgggaatgactgttccatcccacgtttattgacaaaaatcgcctttcagaataggcaaatccacagggacagaaagattgctgggtgcaaggggctggcggagagggaggtctgagaagtgactttttttttttttttaagacaggatctcacgctgcctcccaggctggagtgcggtggagtgataatggctcactgcagccttgacctcgtgggcccaagtgatccttccatctcagcctcccaagtagctgagaccataggtgtgcaccaccatgcccagctaattttatttttctagagacaaggtctccctatgttgctcaggctgttctcaaactagtgggctcaagtgatctcccatcttggcctcccaaagtactgggattacaggcatgagccatggtgcctggctgggagtgacttcttcttggatacagtatccatttgggatcatgaaaaagctcaggaagtagatagtggtgatggttgcataatattggaggtatcctaaatgccactgaattgtgcactttaaaacagggaagttggtaaattttatgttgtttattttaccaccaccaccacaacaaaagataaagaaaacacaacaggtggtcaacacccacaagctatagctttctgacccctgggcaagggctctgtctacagatacagacagatctcagcaacatgttgaacacaagaagcaaattgcagaaggatgtgcagcagacatgcagagggcgctgactgtggttgaataaaaagccagtcaccctcccttcccctccctgaattgagacccattcggctataataggattgaacagttggtgactcctttaaagaaatgacacagccaggtgtggtggctcatgccggctttgggaggccaaggcaggaggatcccttgagcctgggaatttgaggcttcagtgagccataattgcaccactgtactccagcctgggtgacagtgtgaggtcctgtctcaaaaaaaaaaaaagggtcagatgcggtggctcctgcctgtaatttcagcactttgggaggccgaggcgggtggatcatgaggtcaggagttcaagaccagcctggccaacatgatgaaaccccatctctattaaaaatacaaaagttagctgggtgtggtggcgtgtgcctgtaatcccagctactcaagaagctgaggcaggagaaccgcttgaacctgggaggcagaagttgcagtgagccaagatcatgccactgcactccagcctgggtgacagagcgagaccatatatatatatatatggcctaaagtttactgagcaaatccagtgctcaattacatctaacttttcctgtcactaccaatataattttttttttttttggagacggagtctcactctatcacccaggctggagtgcagtggtgcaatctcactgcaacttccgcctccaagattcaagagatccttccgcctcagcctcccaagtaactgggattacaggcataagtcaccatgctgagctaattttggtatttttaggagagacacggtttcaacacgttgggcaggctggtctcgaactcttgacctcaggtgatctgcccaccttggtctcccaaagtgttgggattacaggcatgagccgttgtgccaccccccaatataatcttaatccagcatcttcatacattttatcaccattaccacttctgtctatatatgttacatatataggagagatatatatataggttttatatatataggaaatgtgtatatataggtgttatatatataggagatgcatatatatgttatatatatattatatatataaatattttttatatttatatttttgtatgtgtgtgtgtgtgtatatatatatatatatatacttttttttttttttttttagacagagtctcactgtgttgcccaggctggagtgcagtggcgtgatctcagctcactgcaacctccaactcccgggttcaagcgattctcctgcctcagcctcccaagtagctgggactacagccacctgccaccacacctggctaaatttttttttttttttttgtagttttagtagagatggggtttcactgtgttggccaggctggtcttgaagtcctgagctcgtgatccacctgccttggcctctcaaagttgctgggattgcaggcatgagccactgcacccggccatggttttatattaaaaataataaaaatacggtgaatttctggttgaaatggggaaaggcctgtgatctccgttttcccagtgcttagcgctgactcagagaccctgagtgggacacacgactgcatggagtacagttgggaaacaactgggctagtctgggcctcctgagtctcagaggggagcagggggaagagctctgggcaagtcactgggctgaaccctggccagcccagtgtatgaccctgggtatttcaggtcatggggtgtgagtcctacctcgtgcctcttatcctcctaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggtgagttgggccagtctgttccatcttgctgtcttataccttcctgtggatcttgtcctttccctttctttttaaatgtatgtaccgaaggctatgtatttccctctaaatacagccttagctgtacccacaagttttgatgtgcagtcttttttttattgtcattcagtgtaaaatatttcccaatttgtaatcttttattatttatttattttgagacagggtcttgctatgtcacccaggctggagtgcagtggcacagtcgtggctcactgcagcctcaaactccccaggctcaggtgatcctcctacctcagcctcctgaatagtggggactacaggcgcacaccaccatgccccgctaatttttgtagagatggggtttcaccatgtggcccaggcttgtctcgaactcctgggctcaagtgatcctcctacctcagcctcccaaagtgctgggattacaggtgtaagccactgtgcttggcctaatttcaaaatatataggacttctagtcatcattttgttactattttcctggcttaattgcattgtggtcagagaatgggttccatatgattctagcttttgaaatgtatcgttttaccttatataccccagtacatgtaagtcggaaaagaatggtgtcatcaggtacagtgttctctgtaggttattaggtcaaccttgtaatcatgctgttttatttgtagtgcttctttatctttagtgatatttcacccactgcttattctgtcagttactatgagaggtgcatttaaattcttgctgtgattatggactttgtttcttcttatagttctgtcagttacaatttgtatatattttaagactagattatttggtgcatatatagtttatttttgtttgtttttgagacggagtctcgctctgtcacctaggctggagtgcagtggtgtgatcatagctcactgcaacctccacctcctgggttcaaggaattctcctgcctcagcctccccaggagctgtgactatgagagtgtgccaccacacttggctaactcgtatttctagcagagatggggtttctccatgttggccaggttgctcttgaactcctgacctcaggtaatctccctgcctcagtcttccaaaatgctggggttacaggcgtgagccactgcacccaaccaaggtgcatatatagtttaaattgttctagtacacattccctttctgtcatcctcacctcagtcttagattttgttcctatttggctgcctttcccctttctattaaagttgttggttccagttctcatcctcaggctcctcattcttttttcagttccctcttctctcttttgtgatcatatactttattatttagtataaaaatgaagttaacatgaattcctccctgtctctgctcatctctatgttgacagtttttagtcaggttttctcggtgaggtacataagatgcctctaaccgctccaggccgctgtcccttcggcttagcacctgtaacagctccaggccgctgtcccttcggcctagcacccgtaacagctccagaccgctgtcccttctgcttagcacctgctgaagcagagcccctggacctcagtgtctggccaagtcccagctctgttgctgactgggcccatccctgagctgatccttacgacaagggggactggaaactctaaatggttgggcctagtgatgtgcccaggcctggaggccgtgtccttttcctcccacggcttccacccctgagtcctgggggcggcttcatctcctgccactgcacctgcataccagccagcaggaagagagagggggcaaaggagcaaacatccattcctttcaaaagagcagtccgcaagcggcaccacttaacgccagcatcccatttgccagacgctagtcacatgaccgctcctcgctgcaaggaacagttggagatttgtcttcagctgggtggcctgtgtccggccagggggcctgtgtgggtactgttagtagagggagaaatggaatccatattcgtggaagtgaagcactttggacttagaaatattcatgactatagtgtcattgctgctcctttgtaaggggacatgtttacactcagacctactgactgcattttttattttatttttacttttgagatggagtctcgctctgttgccaggctggagtgcagtggcgcggtctcagctcactgcaacctctgtcccctgggttcaagcaattctcctgcctcaacctcctgagtagctgtgattacaggtgtgctccaccatgcccggctaatttttgtgtttgtagtagagacaggttttgccacgttggccaggctggtctcgaactcttgacctcaagtgatctgcccgcctcagcctcccagagtgctggattataggcatgagccactgtgcctagcctgactgcatttttaaaataatgtaaccagcattctcctcatcaaagatctgttgcaggctgggcgtggtggatcacgcctgtaatcccagcactttgggaggtcgaggcaggcggatcatgaggtcaggagttcaagaccagcctggctaacacagtgaaaccccgtcgctattaaaaatacaaaaaattagctgggcatggtggcaggcgcctgtaatcccagctacctggaaggctgaggcaggagaattgcttgaatccaggaggcagaggttgcagtcagtggagatcgtgccactgcactccagcctgggtgacagtgtgagactccgtctcaaaacaaaaccaaaccaaaacaaaacaaaaaaacatttgttgcagagtagaggtatatgtttatttgatgatactcattcgatgcttatttttgagcccctgctgtgtgccaggcagtctgttaggtgccagggaaatgggtaaacaagacagatctgggcctgtgtgcggctcatagcctcgtggggagacagacattttgggctgatcgctcttgctgcggggccgtcccatgcatcacaggatgtggggcagcctccctggcctccacctatgggatgttgggagcatccctggttgtgagaaccaaaaatgtctctggacgtggccaaatgtcccctggggggcagcattgccccagttgagaactgctggcttaagatataaatagggttatgggagaagacaagtgtgatgaggaggggctttggggtcaggagacagggggatgagggggtggtgactgccaaaaaggggctcagcgtgagatgctgcagggcacagaacactgcccggctgagagcagcaagtgcagaggccagcggcgagcggacgcttggggaaatagcgagggcccagcacagctggggcagggtgagctccgggcaaagcgtgggaaaggtgaagggcaaggtgggcgggaccagagagagggacttgtgcttataaggcctctttgtagaatatcccaggctgtccatctgttcccactttgtgaagctctttctcattgacacagaaactcattccagttctccaaaaatagacacgtcctaccgttaagctgagcttggagagtggccttggacttgtaaccctgcctttgccctcagattgaatggtttaaggtggttattgttttctcgcagaacactgtctcgggtgagggtttctcagcctgggcgctggcagcatgttgggtcaggtccctctccttgtggggctgctgctgagcgctctgagcgcagccgggtgtggagcagcctccctggcctccacccagccgatgccgctaacccttgccctaagttatgacaacaaagatgtctgcagacctgccgggtctcccctgggggacagcattgccctggttgggagtcactgctttaagccagcccgggtcctagagcactactgccctgagacagccctttgggggtcccatccttctgacaggcatgggggctggcaagggtcctgcacttgcatcctccggagctgcctccttacaccccgctgctgccaccttggaatcccacagccagggtgaccccctgccagcaccaggagcaggttccagaggccacctgcagggtcagggtttaacatgtaactgctggtccaaggggagggacaaggcctggtgcagaggggcctcttgtggcagcggatgctgggcagtggctctttaccagcctgtccagggacgtttcagtctcgtggcctgggacctcgttaccaaaccgctggccgaaatcagccctcggccaagggccccgccttggcctctgaccctgagcctccctggcccccaggttgctccttcaggctggctacgacccagagctccgggacggggacggctggactcccctgcacgcagcggcacactggggcgtggaggatgcctgccgcctgctggccgagcatggcgggggcatggactcactgacccatgcggtgagggccagtgcccaggctggtgaggggcagggcgtggggagggcccagcacctccttcattgtctgatcctgctcctcccctgacccaggggcagcgtccctgtgacctggccgatgaggaagtactgagcctgttggaggaactggcccggaaacaggaggacgtgagtgtcagggctgaggggcttaccccagactccccatgtcccctcagctcctcagaggagggtgcagagggggaacccccccgacttctgacacccaccaccccagcgacctgctatttccctcttggtgacccagccccagccccagcctcaggagagacccccagccggggcaggacagagatggggctgcagagcttcctgcctgcctggtggtgggggcggcagaaggatttggacagggttgtctgacaccctgatgaggttgcttagcacacctcatcacctcagggtggcccttggcagcagccatgtgcaggattgtcctagactcaggctgggctggtcacccacaaggtgtcccccagccatccccggggcagccttgctgggaaaacttagagtgaaggagtgaagggcgtgagccttggccagactgcctgggttggaatcccggctctgccatggatctgccgtgagtctcagccagccactttcctttccgggcctcagtttccttatctgtcaaatgggaatggtatggtgcgcaactgtatgaggggtcatgcgtgacacgtggattgtgctgtcaggagctcgggggagtacgtgcccctggaaagcactagagccatgccagcgttcagtgagctctgtgaggtgacaggaagctcccaaggccaggcctagggcttctggtgcgtgggcaggggagcggagacagcttcctcttttgaaaggttggcaggagcgaagtggaggctgatggatgtaggagaagatctcacacaggctggggggcaagtgtgggtgccctgaggtgcccagggaggggagcgtaaggcagggcagacccgggagggccacgagtgccaggcgaggagcatggtggcttccatcctgagggtgatacggccatgaggggtttaataggtggggcagggtcagctcagggggcccagatatggggggagaccagcctgggagcatctggggacactttctggaagacgtgagtactacagcactaagagtttgctagaagggcaggaatgaagggccctcccagtacaaaggtgtgaagacggtggtgaactgcgcggggaaggggcgaagacggtggtgaactgcggggaaggggtgaagacggtggtgaactgcgcggggaaggggcgaagacggtggtgaactgcgcggggaaggggtgaagacggtggtgaactgcgtggggaaggggcgaagacggtggtgaactgcgaactgtgcggggtaggggtgaagacggtggtgaactgcgcggggaaggtgtgaagacggtggtgaactgcgcggagaaggggcgaagacggtggtgaactgcggggaaggggtgaagacggtggtgaactgcagggaaggggtgaagacggtgaactgcggggaaggggcgaagacggtggtgaactgcagggaaggggtgaagacggtggtgaactgcgtggggaaggggtgaagacggtggtgaactgcgaactgcgcggggtaggggtgaagacggtggtgaactgcgcggggaaggtgtgaagacggtggtgaactgcgcggagaaggggtgaagacggtggtgaactgcagggaaggggtgaagacggtggtgaactgcgtggggaaggggtgaagacggtggtgaactgcgaactgcgcggggtaggggtgaagacggtggtgaactgcggggaaggggtgaagacggtggtgaactgcgcggagaaggggcgaagacggtggtgaactgcgcggggaaggggcgaagacggtggtgaactgcgcggggaaggggcgaagacagtggtgaactgcagggaaggggcgaagacggtggtgaactgcggggaaggggcgaagacggtggtgaactgcggggaaggggcgaagacggtggtgaactgcgcggggaaggggcgaagacggtggtgaactgcgcggggaaggggtgaagacggtggtgaactgcgcggggaaggggcgaagacggtggtgaactgcggggaaggtgtgaagacggtggtgaactgcgcggggaaggaggaggcgagtgccggctgcaggagccggggcagctgagggcccaccagtgccctgggtatgctgaggggtcggggtgaggtctaagcaggtctcccctgggagctagaaggacccctctggggatgagactggaggcttctcatgggtgggggccgtgaggacaagacggcagtgcctgcacgtggcagctgcgggcgcctgctggacgcagggcacctcctgcccctgaggtgtgtggccatctgtaggaaaaccagtaagcccacgagccctcggtgcccgcctgggcagtgagctcctgcacagctgtttgtggtggtgttgctgtggggcacgtgtgctccacccctcccctgcagcccccttccctccttgcagcttcggaaccaaaaagaagcttcccagagccggggccaggagccccaagcgccctctagcagcaaacacagaaggtatagggagggaggagtccagggctggcggggtggctggaggccccgggcttgtaccccagcaccctctccttccccaacaggagctctgtgtgtcgtctgagcagtcgcgagaagatttccctccaggacttgtccaaggagcgccggcctggtggggctggggggccccccatccaggacgaggatgagggggaagaaggtcccaccggtgaggggcctgaatctggactcctgggtccgagggaggaggggtcgggttctctgaatctagaggcaactggcatcttctgtgacctgcccggtgttcccacatcacagaaccaccccctgcagaacccagaaccctcaatggcgtctcctccccgccgcaccccagccctaagagtcccgtggtgagtggatgccctgagaggtcctgtgaggctgggagggcccggaggtgggattccatacagcctgtgaacctctggcaggggcagatagggggaagactatagttcccagagtcgtcctggacaaccggcttcctttttaggctgtgcctgccccgggggctgatgggaattgtagtttgttgcagtcctttgggggctaacccttgaggtctgagaagagggatcctttctctctaactgagacctcctccttctcccagcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggtgagtgagggttgggccgggtccaggcccaggcccctgcccagtcgagggaactgccccttcctccccttctcctctccacacaggccaaggagctccgtcttgccagaattaccccgaccccctccccgaagctgccggagccctctgtcctgtgagtccccagggcctgggcccctcaggggtgggtggcagatgtgggttccaagcctgtccgtgtgatcctgagtgagaccatgtaccccctggggtctggttcctgccgccactccagagcctgtgctgtgttcctcttgggggctctctccctccctcaggtctgtgttgaaacgtcaccttctcccctatcttccccccaccccgaggtgcacactgaccaccctgctgccaccacggcgccgtccgcacacgcacaccctcccgctctcagttctcgcactgctgcttctgtccagagtcctttatccttctgaccggttgcgtagtgtgctggtcttttcatggcttttgtgggttttgtgtatttctgctcagctctgactctgttgtggcccagataatttgtttctttcactcacggctgcatctccagtgccggcacacaatgcacctgggtaatgtttgtggaatgaatgaattgatgcaggtctgaggtcaccaagcctcctccttgcttggagaactcctcgcctccctccaggattccggagcctgaatccccagcgaagccaaacgtccccacagcctccacggcgcccccagcggactcccgggaccgacggaggtgaagaggccagggcaggaagctgccgcccccgcccccagcagggagagacgatgtgaagcaggagtcccggggctttgggtgggctcctgagggagagctggcctcaggtctgctgggagttggagtcccctcccacagaacttgcttcccgcggagggtgtcagccacggaatgggacagggtccccaggttccctgtctgaggttgggacccttccctcaggtcctaccagatgcctgtgcgggatgaggagtcggaatcccagagaaaagctcgctcccgtctcatgcgccagtctcggaggtccacacaggtgtggggtgggctggggtctggactcctgggtctgagggaggaggggctggggcctggactcctgggtctgagggaggaggggctgggggcctggattcctgggtctgagggaggaggggctggggcctggactcctgggtctgagggaggaggggctggaggtctggactcctgggtctgagggaggaggggctggggcctggactcctgggtctgagggaggaggggctggggcctgggctcctgggtctgagggaggaggggctggggcctggactcctgggtctgagggaggaggggctggaggtctggactcctgggtctgagggaggaggggctggggcctggactcctgggtctgagggaggaggggctggggcctgggctcctgggtctgagggaggaggggctggggcctggactcctgggtctgagggaggaggggctggggtctgggctcctgggtctgagggaggaggggctggaggtctggactcctgggtctgagggaggaggggctggggcctggactcctgggtctgagggaggaggggctggggtctgggctcctgggtctgagggaggaggggctggggcctgggctcctgggtctgagggaggaggggctggggtctgggctcctgggtctgagggaggaggggctggggcctgggctcctgggtctgagggaggaggggctggggtctgggctcctgggtctgagggaggaggggctggaggtctggactcctgggtctgagggaggaggggctggggcctgggctcctgggtctgagggaggaggggctggaggtctggactcctgggtctgagggaggaggggctggggcctggactcctgggtctgagggaggaggggctggaggtctggactcctgggtctgagggaggaggggctggggcctggactcctgggtctgagggaggaggggctggaggtctggactcctgggtctgagggaggaggggctggggtctgggctcctgggtctgagggaggaggggctggggcctgggctcctgggtctgagggaggaggggctgggccctgaccccagcgtcccctgactgtcccctttccctgccagggtgtgactcttacagacctgaaggaggcagagaaggctgcagggaaggccccagagtcagagaagccggcgcagagcctggtgagaggggtcagcgagggcgagtggggtggtgcgggatgtcctgcttccctgactcgcctccccctcccgacaggacccttcccgaaggccccgcgtccctggagtggagaactctgacagccctgcccagagaggtgaggtctgctctcggggaggtcattcccagggaatcatccagtttctcccatagtcttcttgctttcctgggggcttgacccggggacccaggcaccgagagggggctctggaggtgcctgggctgattcctgcccctcccccagcagaggcgcccgacgggcagggtccgggaccgcaggcggccagggagcaccgcaaggtcggaaaggagtggagggggcctgcggaggtgaggggctcaggtggggccgagctggtgcagagggtgggccggggggcgggcaaagcccttcccatacccgctaaagtccctcccatacccattgaacccccgtctacctgcccacagggggaggaggcggagccggctgaccgcagccaggagtccaggtaggggcggggtgggagaggtggggtctgcgtgcgggccgggccggcccctgacgcgcgctcctcccctgccccagcaccctggagggcggcccctcggcccgcaggcagcggtggcagcgggacctcaacccagaacctgagccagaatcggaagagccagacggaggctttaggacggtgcgatcccacccctccgtcggggctttgcctgctgggtgcccagcttcctggcttccccgcccccccagcatcgccccatcctccacctgaccctcctctacctgacccccagctgtatgcagagctgcgcagggagaacgagcggcttcgcgaggccctgaccgagaccacgctgcggctggcgcagctcaaggtggagctggagcgggccacgcaggtaagggcgccgaggccagggtcacgggaactggcagggccgcctgggtggggcttagactgctgggaggtagagcctggcctgggggtgccggcggggctgggcttcacttgaggggcggggccgagatctcggaggcggagtctgagcgaggggatggggctgtgggcctgccggtggcggggcctggcccgtgggggaagggcttgtgggctgcctagtgggcgggcgggtgcccagcaggagcctaggacccttcagagcagtgctggcttcttctgctgacccctgtgctttctgtgtcctcaccagaggcaagaacgcttcgctgagaggccagccctcctggaactggagagattcgtgagtaggggcagtggggatgggggccagaggcgtccccagcctcacatccctaagtttggaccaagggagccacattgcccttcccagctggcccctggccttcccctgccctcctcagcctcactcagtttctgcactttccctgttcattccaggagcgcagggccctggaacgcaaggccgcagagctggaggaggagctgaaggtgggggctgtgggggctgtgggcagagggccgagggtgggtgggggtgcaacccgccagggctgcccagctgacccttgccgtcccccaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaa

SEQ ID NO: 124-194 - skipped (71 entries)

SEQ ID NO: 195 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 196 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 197 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggaggtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 198 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgagaacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 199 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaataaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 200 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatcaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 201 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatgaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 202 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatcttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 203 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 204 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 205 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatgaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 206 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgagaacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 207 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatcaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 208 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgagaacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 209 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatgaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 210 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaataaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 211 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatcaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 212 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatcttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 213 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatattatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 214 - DNA, 7327 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 215 - DNA, 7312 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 216 - DNA, 7300 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 217 - DNA, 7312 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgctgacggttatcttccagattggctcgaggacaacctctctgagggcattcgcgagtggtgggacctgaaacctggagccccgaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaaaacggctcctggaaagaagagaccgttagagtcaccacaagagcccgactcctcctcgggcatcggcaaaaaaggcaaacaaccagccagaaagaggctcaactttgaagaggacactggagccggagacggaccccctgaaggatcagataccagcgccatgtcttcagacattgaaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 218 - DNA, 7339 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgctgacggttatcttccagattggctcgaggacaacctctctgaaggcattcgcgagtggtgggcgctgaaacctggagctccacaacccaaggccaaccaacagcatcaggacaacggcaggggtcttgtgcttcctgggtacaagtacctcggacccttcaacggactcgacaagggagagccggtcaacgaggcagacgccgcggccctcgagcacgacaaggcctacgacaagcagctcgagcagggggacaacccgtatctcaagtacaaccacgccgacgccgagttccagcagcgcttggcgaccgacacctcttttgggggcaacctcgggcgagcagtcttccaggccaaaaagaggattctcgagcctctgggtctggttgaagagggcgttaaaacggctcctggaaagaaacgcccattagaaaagactccaaatcggccgaccaacccggactctgggaaggccccggccaagaaaaagcaaaaagacggcgaaccagccgactctgctagaaggacactcgactttgaagactctggagcaggagacggaccccctgagggatcatcttccggagaaatgtctcatgatgctgagatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 219 - DNA, 7330 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgctgacggttatcttccagattggctcgaggacaacctctctgaaggcattcgcgagtggtgggcgctgaaacctggagctccacaacccaaggccaaccaacagcatcaggacaacggcaggggtcttgtgcttcctgggtacaagtacctcggacccttcaacggactcgacaagggagagccggtcaacgaggcagacgccgcggccctcgagcacgacaaggcctacgacaagcagctcgagcagggggacaacccgtatctcaagtacaaccacgccgacgccgagttccagcagcgcttggcgaccgacacctcttttgggggcaacctcgggcgagcagtcttccaggccaaaaagaggattctcgagcctctgggtctggttgaagagggcgttaaaacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 220 - DNA, 7327 bp, Artificial Sequence
  Description of Artificial Sequence: Synthetic polynucleotide
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 221 - DNA, 4478 bp, Artificial Sequence
  Description of Artificial Sequence: Synthetic polynucleotide
ggaaataagagagaaaagaagagtaagaagaaatataagagccaccatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctacctggccctggcccacatgatcaagttcagaggccacttcctgatcgagggcgacctgaaccccgacaacagcgacgtggacaagctgttcatccagctggtgcagacctacaaccagctgttcgaggaaaaccccatcaacgccagcggcgtggacgccaaggctatcctgtctgccagactgagcaagagcagaaggctggaaaatctgatcgcccagctgcccggcgagaagaagaacggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgttcctggccgccaagaacctgtctgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagaaatcttcttcgaccagagcaagaacggctacgccggctacatcgatggcggcgctagccaggaagagttctacaagttcatcaagcccatcctggaaaagatggacggcaccgaggaactgctcgtgaagctgaacagagaggacctgctgagaaagcagagaaccttcgacaacggcagcatcccccaccagatccacctgggagagctgcacgctatcctgagaaggcaggaagatttttacccattcctgaaggacaaccgggaaaagatcgagaagatcctgaccttcaggatcccctactacgtgggccccctggccagaggcaacagcagattcgcctggatgaccagaaagagcgaggaaaccatcaccccctggaacttcgaggaagtggtggacaagggcgccagcgcccagagcttcatcgagagaatgacaaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaggccatcgtggacctgctgttcaagaccaacagaaaagtgaccgtgaagcagctgaaagaggactacttcaagaaaatcgagtgcttcgactccgtggaaatctccggcgtggaagatagattcaacgcctccctgggcacataccacgatctgctgaaaattatcaaggacaaggacttcctggataacgaagagaacgaggacattctggaagatatcgtgctgaccctgacactgtttgaggaccgcgagatgatcgaggaaaggctgaaaacctacgctcacctgttcgacgacaaagtgatgaagcagctgaagagaaggcggtacaccggctggggcaggctgagcagaaagctgatcaacggcatcagagacaagcagagcggcaagacaatcctggatttcctgaagtccgacggcttcgccaaccggaacttcatgcagctgatccacgacgacagcctgacattcaaagaggacatccagaaagcccaggtgtccggccagggcgactctctgcacgagcatatcgctaacctggccggcagccccgctatcaagaagggcatcctgcagacagtgaaggtggtggacgagctcgtgaaagtgatgggcagacacaagcccgagaacatcgtgatcgagatggctagagagaaccagaccacccagaagggacagaagaactcccgcgagaggatgaagagaatcgaagagggcatcaaagagctgggcagccagatcctgaaagaacaccccgtggaaaacacccagctgcagaacgagaagctgtacctgtactacctgcagaatggccgggatatgtacgtggaccaggaactggacatcaacagactgtccgactacgatgtggaccatatcgtgcctcagagctttctgaaggacgactccatcgataacaaagtgctgactcggagcgacaagaacagaggcaagagcgacaacgtgccctccgaagaggtcgtgaagaagatgaagaactactggcgacagctgctgaacgccaagctgattacccagaggaagttcgataacctgaccaaggccgagagaggcggcctgagcgagctggataaggccggcttcatcaagaggcagctggtggaaaccagacagatcacaaagcacgtggcacagatcctggactcccggatgaacactaagtacgacgaaaacgataagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgaaatcaccctggccaacggcgagatcagaaagcgccctctgatcgagacaaacggcgaaaccggggagatcgtgtgggataagggcagagacttcgccacagtgcgaaaggtgctgagcatgccccaagtgaatatcgtgaaaaagaccgaggtgcagacaggcggcttcagcaaagagtctatcctgcccaagaggaacagcgacaagctgatcgccagaaagaaggactgggaccccaagaagtacggcggcttcgacagccctaccgtggcctactctgtgctggtggtggctaaggtggaaaagggcaagtccaagaaactgaagagtgtgaaagagctgctggggatcaccatcatggaaagaagcagctttgagaagaaccctatcgactttctggaagccaagggctacaaagaagtgaaaaaggacctgatcatcaagctgcctaagtactccctgttcgagctggaaaacggcagaaagagaatgctggcctctgccggcgaactgcagaagggaaacgagctggccctgcctagcaaatatgtgaacttcctgtacctggcctcccactatgagaagctgaagggcagccctgaggacaacgaacagaaacagctgtttgtggaacagcataagcactacctggacgagatcatcgagcagatcagcgagttctccaagagagtgatcctggccgacgccaatctggacaaggtgctgtctgcctacaacaagcacagggacaagcctatcagagagcaggccgagaatatcatccacctgttcaccctgacaaacctgggcgctcctgccgccttcaagtactttgacaccaccatcgaccggaagaggtacaccagcaccaaagaggtgctggacgccaccctgatccaccagagcatcaccggcctgtacgagacaagaatcgacctgtctcagctgggaggcgacaagagacctgccgccactaagaaggccggacaggccaaaaagaagaagtgagcggccgcttaattaagctgccttctgcggggcttgccttctggccatgcccttcttctctcccttgcacctgtacctcttggtctttgaataaagcctgagtaggaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 222-245 - skipped (24 entries)

SEQ ID NO: 246 - DNA, 2532 bp, Adeno-associated virus 6
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 247 - DNA, 154 bp, Artificial Sequence
  Description of Artificial Sequence: Synthetic polynucleotide
atcgatcgcaggcgcaatcttcgcatttcttttttccagagagccaaaagaggttctggcgagggcaggggttccctccttacatgcggagatgtagaagaaaatccagggcctatgggcccaggtctgctttgctgggcgttgttgtgccttc

SEQ ID NO: 248 - protein, 13 aa, Artificial Sequence
  Description of Artificial Sequence: Synthetic peptide
MGPGLLCWALLCL

SEQ ID NO: 249-260 - skipped (12 entries)

SEQ ID NO: 261 - DNA, 26 bp, Artificial Sequence
  Description of Artificial Sequence: Synthetic primer
gctgcgtcaactggaccaatgagaac

SEQ ID NO: 262 - DNA, 23 bp, Artificial Sequence
  Description of Artificial Sequence: Synthetic primer
ggtaatgcctcaggaaattggca

SEQ ID NO: 263 - DNA, 29 bp, Artificial Sequence
  Description of Artificial Sequence: Synthetic primer
gaatccccagttgttgttgttgatgagtc

SEQ ID NO: 264 - DNA, 28 bp, Artificial Sequence
  Description of Artificial Sequence: Synthetic primer
cgcagagaccaaagttcaactgaaacga

SEQ ID NO: 265 - DNA, 20 bp, Artificial Sequence
  Description of Artificial Sequence: Synthetic primer
atggctgccgatggttatct

SEQ ID NO: 266 - DNA, 21 bp, Artificial Sequence
  Description of Artificial Sequence: Synthetic primer
gcaccaatggcagacaataav

SEQ ID NO: 267 - protein, 736 aa, Artificial Sequence; identical to SEQ ID NO: 27
  Description of Artificial Sequence: Synthetic polypeptide

SEQ ID NO: 268 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 269 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFENVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 270 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNNQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 271 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNHQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 272 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNDQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 273 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHLMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 274 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHIMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 275 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 276 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 277 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNDQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 278 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFENVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 279 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNHQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 280 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFENVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 281 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNDQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 282 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNNQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 283 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNHQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 284 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHLMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 285 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHIMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 286 - DNA, 2211 bp, Adeno-associated virus 6; identical to SEQ ID NO: 55

SEQ ID NO: 287 - DNA, 2205 bp, Adeno-associated virus 4
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 288 - DNA, 2175 bp, Adeno-associated virus 5
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 289 - DNA, 2202 bp, Adeno-associated virus 11
atggctgctgacggttatcttccagattggctcgaggacaacctctctgagggcattcgcgagtggtgggacctgaaacctggagccccgaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaaaacggctcctggaaagaagagaccgttagagtcaccacaagagcccgactcctcctcgggcatcggcaaaaaaggcaaacaaccagccagaaagaggctcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcgtctcggaacaacatcaagcagcaacacctacaacggattctccaccccctggggatattttgacttcaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagaggggagcctgcctcctttccccaatgacgtgttcatggtgcctcaatatggctactgtggcatcgtgactggcgagaatcagaaccaaacggacagaaacgctttctactgcctggagtattttccttcgcaaatgttgagaactggcaacaactttgaaatggcttacaactttgagaaggtgccgttccactcaatgtatgctcacagccagagcctggacagactgatgaatcccctcctggaccagtacctgtggcacttacagtcgactacctctggagagactctgaatcaaggcaatgcagcaaccacatttggaaaaatcaggagtggagactttgccttttacagaaagaactggctgcctgggccttgtgttaaacagcagagattctcaaaaactgccagtcaaaattacaagattcctgccagcgggggcaacgctctgttaaagtatgacacccactataccttaaacaaccgctggagcaacatcgcgcccggacctccaatggccacagccggaccttcggatggggacttcagtaacgcccagcttatattccctggaccatctgttaccggaaatacaacaacttcagccaacaatctgttgtttacatcagaagaagaaattgctgccaccaacccaagagacacggacatgtttggccagattgctgacaataatcagaatgctacaactgctcccataaccggcaacgtgactgctatgggagtgctgcctggcatggtgtggcaaaacagagacatttactaccaagggccaatttgggccaagatcccacacgcggacggacattttcatccttcaccgctgattggtgggtttggactgaaacacccgcctccccagatattcatcaagaacactcccgtacctgccaatcctgcgacaaccttcactgcagccagagtggactctttcatcacacaatacagcaccggccaggtcgctgttcagattgaatgggaaattgaaaaggaacgctccaaacgctggaatcctgaagtgcagtttacttcaaactatgggaaccagtcttctatgttgtgggctcctgatacaactgggaagtatacagagccgcgggttattggctctcgttatttgactaatcatttgtaa

SEQ ID NO: 290 - DNA, 2229 bp, Adeno-associated virus 12
atggctgctgacggttatcttccagattggctcgaggacaacctctctgaaggcattcgcgagtggtgggcgctgaaacctggagctccacaacccaaggccaaccaacagcatcaggacaacggcaggggtcttgtgcttcctgggtacaagtacctcggacccttcaacggactcgacaagggagagccggtcaacgaggcagacgccgcggccctcgagcacgacaaggcctacgacaagcagctcgagcagggggacaacccgtatctcaagtacaaccacgccgacgccgagttccagcagcgcttggcgaccgacacctcttttgggggcaacctcgggcgagcagtcttccaggccaaaaagaggattctcgagcctctgggtctggttgaagagggcgttaaaacggctcctggaaagaaacgcccattagaaaagactccaaatcggccgaccaacccggactctgggaaggccccggccaagaaaaagcaaaaagacggcgaaccagccgactctgctagaaggacactcgactttgaagactctggagcaggagacggaccccctgagggatcatcttccggagaaatgtctcatgatgctgagatgcgtgcggcgccaggcggaaatgctgtcgaggcgggacaaggtgccgatggagtgggtaatgcctccggtgattggcattgcgattccacctggtcagagggccgagtcaccaccaccagcacccgaacctgggtcctacccacgtacaacaaccacctgtacctgcgaatcggaacaacggccaacagcaacacctacaacggattctccaccccctggggatactttgactttaaccgcttccactgccacttttccccacgcgactggcagcgactcatcaacaacaactggggactcaggccgaaatcgatgcgtgttaaaatcttcaacatacaggtcaaggaggtcacgacgtcaaacggcgagactacggtcgctaataaccttaccagcacggttcagatctttgcggattcgacgtatgaactcccatacgtgatggacgccggtcaggaggggagctttcctccgtttcccaacgacgtctttatggttccccaatacggatactgcggagttgtcactggaaaaaaccagaaccagacagacagaaatgccttttactgcctggaatactttccatcccaaatgctaagaactggcaacaattttgaagtcagttaccaatttgaaaaagttcctttccattcaatgtacgcgcacagccagagcctggacagaatgatgaatcctttactggatcagtacctgtggcatctgcaatcgaccactaccggaaattcccttaatcaaggaacagctaccaccacgtacgggaaaattaccactggagactttgcctactacaggaaaaactggttgcctggagcctgcattaaacaacaaaaattttcaaagaatgccaatcaaaactacaagattcccgccagcgggggagacgcccttttaaagtatgacacgcataccactctaaatgggcgatggagtaacatggctcctggacctccaatggcaaccgcaggtgccggggactcggattttagcaacagccagctgatctttgccggacccaatccgagcggtaacacgaccacatcttcaaacaatttgttgtttacctcagaagaggagattgccacaacaaacccacgagacacggacatgtttggacagattgcagataataatcaaaatgccaccaccgcccctcacatcgctaacctggacgctatgggaattgttcccggaatggtctggcaaaacagagacatctactaccagggccctatttgggccaaggtccctcacacggacggacactttcacccttcgccgctgatgggaggatttggactgaaacacccgcctccacagattttcatcaaaaacacccccgtacccgccaatcccaatactacctttagcgctgcaaggattaattcttttctgacgcagtacagcaccggacaagttgccgttcagatcgactgggaaattcagaaggagcattccaaacgctggaatcccgaagttcaatttacttcaaactacggcactcaaaattctatgctgtgggctcccgacaatgctggcaactaccacgaactccgggctattgggtcccgtttcctcacccaccacttgtaa

SEQ ID NO: 291 - DNA, 2208 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 292 - DNA, 2208 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 293 - DNA, 2211 bp, Artificial Sequence
  Description of Artificial Sequence: Synthetic polynucleotide
atggctgctgacggttatcttccagattggctcgaggacaacctctctgaaggcattcgcgagtggtgggcgctgaaacctggagctccacaacccaaggccaaccaacagcatcaggacaacggcaggggtcttgtgcttcctgggtacaagtacctcggacccttcaacggactcgacaagggagagccggtcaacgaggcagacgccgcggccctcgagcacgacaaggcctacgacaagcagctcgagcagggggacaacccgtatctcaagtacaaccacgccgacgccgagttccagcagcgcttggcgaccgacacctcttttgggggcaacctcgggcgagcagtcttccaggccaaaaagaggattctcgagcctctgggtctggttgaagagggcgttaaaacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 294 - DNA, 2193 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 295 - DNA, 2181 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 296 - DNA, 2193 bp, Artificial Sequence
  Description of Artificial Sequence: Synthetic polynucleotide
atggctgctgacggttatcttccagattggctcgaggacaacctctctgagggcattcgcgagtggtgggacctgaaacctggagccccgaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaaaacggctcctggaaagaagagaccgttagagtcaccacaagagcccgactcctcctcgggcatcggcaaaaaaggcaaacaaccagccagaaagaggctcaactttgaagaggacactggagccggagacggaccccctgaaggatcagataccagcgccatgtcttcagacattgaaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 297 - DNA, 2220 bp, Artificial Sequence
  Description of Artificial Sequence: Synthetic polynucleotide
atggctgctgacggttatcttccagattggctcgaggacaacctctctgaaggcattcgcgagtggtgggcgctgaaacctggagctccacaacccaaggccaaccaacagcatcaggacaacggcaggggtcttgtgcttcctgggtacaagtacctcggacccttcaacggactcgacaagggagagccggtcaacgaggcagacgccgcggccctcgagcacgacaaggcctacgacaagcagctcgagcagggggacaacccgtatctcaagtacaaccacgccgacgccgagttccagcagcgcttggcgaccgacacctcttttgggggcaacctcgggcgagcagtcttccaggccaaaaagaggattctcgagcctctgggtctggttgaagagggcgttaaaacggctcctggaaagaaacgcccattagaaaagactccaaatcggccgaccaacccggactctgggaaggccccggccaagaaaaagcaaaaagacggcgaaccagccgactctgctagaaggacactcgactttgaagactctggagcaggagacggaccccctgagggatcatcttccggagaaatgtctcatgatgctgagatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 298 - DNA, 591 bp, Artificial Sequence
  Description of Artificial Sequence: Synthetic polynucleotide
ctggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatga

SEQ ID NO: 299 - DNA, 597 bp, Artificial Sequence
  Description of Artificial Sequence: Synthetic polynucleotide
ttgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtga

SEQ ID NO: 300 - DNA, 681 bp, Artificial Sequence
  Description of Artificial Sequence: Synthetic polynucleotide
acgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctga

SEQ ID NO: 301 - DNA, 594 bp, Artificial Sequence
  Description of Artificial Sequence: Synthetic polynucleotide
agtcaccacaagagcccgactcctcctcgggcatcggcaaaaaaggcaaacaaccagccagaaagaggctcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcgtctcggaacaacatcaagcagcaacacctacaacggattctccaccccctggggatattttgacttcaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtga

SEQ ID NO: 302 - DNA, 621 bp, Artificial Sequence
  Description of Artificial Sequence: Synthetic polynucleotide
aaaagactccaaatcggccgaccaacccggactctgggaaggccccggccaagaaaaagcaaaaagacggcgaaccagccgactctgctagaaggacactcgactttgaagactctggagcaggagacggaccccctgagggatcatcttccggagaaatgtctcatgatgctgagatgcgtgcggcgccaggcggaaatgctgtcgaggcgggacaaggtgccgatggagtgggtaatgcctccggtgattggcattgcgattccacctggtcagagggccgagtcaccaccaccagcacccgaacctgggtcctacccacgtacaacaaccacctgtacctgcgaatcggaacaacggccaacagcaacacctacaacggattctccaccccctggggatactttgactttaaccgcttccactgccacttttccccacgcgactggcagcgactcatcaacaacaactggggactcaggccgaaatcgatgcgtgttaaaatcttcaacatacaggtcaaggaggtcacgacgtcaaacggcgagactacggtcgctaataaccttaccagcacggttcagatctttgcggattcgacgtatgaactcccatacgtga

SEQ ID NO: 303 - DNA, 663 bp, Artificial Sequence
  Description of Artificial Sequence: Synthetic polynucleotide
ttgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatga

SEQ ID NO: 304 - DNA, 654 bp, Artificial Sequence
  Description of Artificial Sequence: Synthetic polynucleotide
acgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatga

SEQ ID NO: 305 - DNA, 660 bp, Artificial Sequence
  Description of Artificial Sequence: Synthetic polynucleotide
agtcaccacaagagcccgactcctcctcgggcatcggcaaaaaaggcaaacaaccagccagaaagaggctcaactttgaagaggacactggagccggagacggaccccctgaaggatcagataccagcgccatgtcttcagacattgaaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatga

SEQ ID NO: 306 - DNA, 687 bp, Artificial Sequence
  Description of Artificial Sequence: Synthetic polynucleotide
aaaagactccaaatcggccgaccaacccggactctgggaaggccccggccaagaaaaagcaaaaagacggcgaaccagccgactctgctagaaggacactcgactttgaagactctggagcaggagacggaccccctgagggatcatcttccggagaaatgtctcatgatgctgagatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatga

SEQ ID NO: 307 - protein, 110 aa, Artificial Sequence
  Description of Artificial Sequence: Synthetic polypeptide
AKKRILEPLGLVEEGVKTAPGKKRPLEKTPNRPTNPDSGKAPAKKKQKDGEPADSARRTLDFEDSGAGDGPPEGSSSGEMSHDAEMASGGGAPMADNNEGADGVGNASGN

SEQ ID NO: 308 - protein, 107 aa, Artificial Sequence
  Description of Artificial Sequence: Synthetic polypeptide
AKKRILEPLGLVEEGVKTAPGKKRPVEQSPQEPDSSSGIGKTGQQPAKKRLNFGQTGDSESVPDPQPLGEPPATPAAVGPTTMASGGGAPMADNNEGADGVGNASGN

SEQ ID NO: 309 - protein, 107 aa, Adeno-associated virus 6
AKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGN
